(12) United States Patent
Place et al.

(10) Patent No.: US 11,597,930 B2
(45) Date of Patent: Mar. 7, 2023

(54) TARGETED INHIBITION USING ENGINEERED OLIGONUCLEOTIDES

(71) Applicant: miRecule, Inc., Gaithersburg, MD (US)

(72) Inventors: Robert Place, Gaithersburg, MD (US); Anthony Saleh, Gaithersburg, MD (US); Tishan Williams, Gaithersburg, MD (US)

(73) Assignee: MIRECULE, INC., Gaithersburg, MD (US)

( * ) Notice: Subject to any disclaimer, the term of this patent is extended or adjusted under 35 U.S.C. 154(b) by 0 days.

(21) Appl. No.: 17/692,644

(22) Filed: Mar. 11, 2022

(65) Prior Publication Data

US 2022/0213481 A1    Jul. 7, 2022

Related U.S. Application Data

(63) Continuation of application No. PCT/US2021/025639, filed on Apr. 2, 2021.

(60) Provisional application No. 63/004,045, filed on Apr. 2, 2020.

(51) Int. Cl.
| | |
|---|---|
| *C07H 21/04* | (2006.01) |
| *C12N 15/113* | (2010.01) |
| *A61K 31/7088* | (2006.01) |

(52) U.S. Cl.
CPC ........ *C12N 15/113* (2013.01); *A61K 31/7088* (2013.01); *C12N 2310/141* (2013.01)

(58) Field of Classification Search
None
See application file for complete search history.

(56) References Cited

U.S. PATENT DOCUMENTS

| | | | |
|---|---|---|---|
| 4,373,071 | A | 2/1983 | Itakura |
| 4,401,796 | A | 8/1983 | Itakura |
| 4,415,732 | A | 11/1983 | Caruthers |
| 4,458,066 | A | 7/1984 | Caruthers |
| 4,500,707 | A | 2/1985 | Caruthers |
| 4,668,777 | A | 5/1987 | Caruthers |
| 4,973,679 | A | 11/1990 | Caruthers |
| 5,047,524 | A | 9/1991 | Andrus |
| 5,132,418 | A | 7/1992 | Caruthers |
| 5,153,319 | A | 10/1992 | Caruthers |
| 5,262,530 | A | 11/1993 | Andrus |
| 5,700,642 | A | 12/1997 | Monforte |
| 8,586,727 | B2 | 11/2013 | Kelnar |
| 8,796,238 | B2 | 8/2014 | Forbes |
| 2007/0099196 | A1* | 5/2007 | Kauppinen ........... C12N 15/111 435/6.1 |
| 2007/0248659 | A1 | 10/2007 | Shanahan |
| 2008/0306006 | A1 | 12/2008 | Croce |
| 2009/0148535 | A1 | 6/2009 | Bamdad |
| 2009/0203051 | A1 | 8/2009 | Gray |
| 2011/0143950 | A1 | 6/2011 | Zama |
| 2012/0015351 | A1 | 1/2012 | Lee |
| 2012/0190730 | A1* | 7/2012 | Michael ..................... A61P 1/00 435/375 |
| 2013/0115299 | A1 | 5/2013 | Chiou |
| 2014/0011862 | A1 | 1/2014 | Bradner |
| 2015/0313932 | A1 | 11/2015 | Carrasco |
| 2017/0218372 | A1 | 8/2017 | Milsom |
| 2020/0248179 | A1 | 8/2020 | Harper |

FOREIGN PATENT DOCUMENTS

| | | |
|---|---|---|
| JP | 2006248978 A | 9/2006 |
| JP | 2009519339 A | 5/2009 |
| JP | 2010535246 A | 11/2010 |
| JP | 2012529295 A | 11/2012 |
| JP | 2014506791 A | 3/2014 |
| JP | 2014530222 A | 11/2014 |
| WO | 2003093441 A2 | 11/2003 |
| WO | 2005017145 A1 | 2/2005 |
| WO | 2006099169 A2 | 9/2006 |
| WO | 2006133022 A2 | 12/2006 |
| WO | 2007033023 A2 | 3/2007 |
| WO | 2007070483 A2 | 6/2007 |
| WO | 2007149521 A2 | 12/2007 |
| WO | 2008069940 A2 | 6/2008 |
| WO | 2008088858 A2 | 7/2008 |
| WO | 2009018492 A2 | 2/2009 |
| WO | 2010065630 A2 | 6/2010 |
| WO | 2010144485 A1 | 12/2010 |
| WO | 2012106586 A1 | 8/2012 |
| WO | 2012106591 A1 | 8/2012 |
| WO | 2013052965 A2 | 4/2013 |
| WO | 2016170348 A2 | 10/2016 |

OTHER PUBLICATIONS

Mao, Ling, et al. "miR-30 family: a promising regulator in development and disease." BioMed research international 2018 (2018).*
Boise, LH et al., *H.sapiens* bcl-xL mRNA. Genbank entry (online). National Center for Biotechnology Information. Oct. 7, 2008 [retrieved on Aug. 24, 2021], pp. 1-2.
Brutlag et al., Improved sensitivity of biological sequence database searches, Comp. App. Biosci. 6:237-245 (1990).
Gruber, AR et al., The Vienna RNA Websuite. Nucleic Acids Research. Jul. 1, 2008, vol. 36; pp. W70-74.
International Search Report and Written Opinion PCT/US21/25639, dated Sep. 20, 2021.
Simoes-Wust, AP et al., A Functionally Improved Locked Nucleic Acid Antisense Oligonucleotide Inhibits Bcl-2 and Bcl-xL Expression and Facilitates Tumor Cell Apoptosis. Oligonucleotides. 2004, vol. 14, No. 3; pp. 199-209.
Yu, Met al., *Homo sapiens* BCL2 apoptosis regulator (BCL2), transcript variant alpha, mRNA. Genbank entry (online). National Center for Biotechnology Information. Mar. 29, 2020 [retrieved on Aug. 24, 2021], p. 1-6.
Zeng, Y et al., Both Natural and Designed Micro RNAs Can Inhibit the Expression of Cognate mRNAs When Expressed in Human Cells. Molecular Cell. mRNAs When Expressed in Human Cells. Molecular Cell. Jun. 2002, vol. 9, No. 6; pp. 1327-1333.

(Continued)

*Primary Examiner* — Kimberly Chong
(74) *Attorney, Agent, or Firm* — Greenberg Traurig, LLP

(57) ABSTRACT

Disclosed herein are engineered oligonucleotides for selective inhibition of polypeptide expression and activity. Also disclosed herein are methods of selectively inhibiting polypeptide expression and activity contacting an engineered oligonucleotide with a polynucleotide encoding the polypeptide.

16 Claims, 38 Drawing Sheets

Specification includes a Sequence Listing.

(56) References Cited

OTHER PUBLICATIONS

"Squamous cell carcinoma—Wikipedia", XP055722287, Retrieved from the Internet: https://en.wikipedia.org/wiki/Squamous_cell_carcinoma, May 27, 2020 (retrieved on Aug. 5, 2022) (6 pages).

Baraniskin et al., "MiR-30s-5p suppresses tumor growth in colon carcinoma by targeting DTL," Carcinogenesis, vol. 33, No. 4, pp. 732-739, 2012.

Zhao et al., "miR-30-5p Functions as a Tumor Suppressor and Novel Therapeutic Tool by Targeting the Oncogenic Wnt/β-Catenin/BCL9 Pathway," Cancer Research, vol. 74, No. 6, pp. 1801-1813, 2014.

Chernolovska Ya et al., "Chemical modification of siRNA," Current Opinion in Molecular Therapeutics, vol. 12, No 2, pp. 158-167, 2010.

De Paula et al., "Hydrophobization and bioconjugation for enhanced siRNA delivery and targeting," RNA, vol. 13, No. 4, pp. 431-456, 2007.

Fukumoto et al., "Tumor-suppressive microRNAs (miR-26alb, mir-29alb/c and miR-218) concertedly suppressed metastasis-promoting LOXL2 in head and neck squamous cell carcinoma," Journal of Human Genetics, vol. 61, No. 2, pp. 109-118, 2016.

Gao et al., "The role of miR-26 in tumors and normal tissues (Review)," Oncology Letters, vol. 2, pp. 1019-1023, 2011.

He et al., "MicroRNA-375 targets AEG-1 in hepatocellular carcinoma and suppresses liver cancer cell growth in vitro and in vivo," Oncogene, vol. 31, No. 28, pp. 3357-3369, 2012.

Hoadley et al., "Multiplatform Analysis of 12 Cancer Types Reveals Molecular Classification within and across Tissues of Origin," Cell vol. 158, pp. 929-944, 2014.

Hou et al., "MicroRNA as ideal biomarker for the diagnosis of various carcinomas," Tumor Biology, vol. 36, No. 4, pp. 2641-2649, 2015.

Kano et al., "miR-145, miR-133a and miR-133b: Tumor-suppressive miRNAs target FSCNI in esophageal squamous cell carcinoma," International Journal of Cancer, vol. 127, No. 12, pp. 2804-2814, 2010.

Kao et al., "miR-30 as a tumor suppressor connects EGF/Src signal to ERG and EMT," Oncogene, vol. 33, No. 19, pp. 2495-2503, 2014.

Karatas et al., "Role of miR-145 in human laryngeal squamous cell carcinoma," Head and Neck, vol. 38, No. 2, pp. 260-266, 2016.

Zhang et al., "Role of microRNA-30c Targeting ADAM19 in Colorectal Cancer," PLoS One, vol. 10, No. 3, e0120698, 2015 (14 pages).

Kota et al.,"Therapeutic microRNA Delivery Suppresses Tumorigenesis in a Murine Liver Cancer Model," Cell, vol. 137, No. 6, pp. 1005-1017, 2009.

Lindenbergh-Van Der Plas et al., "Identification of Lethal microRNAs Specific for Head and Neck Cancer," Clinical Cancer Research, vol. 19, No. 20, pp. 5647-5657, 2013.

Ling et al., "MicroRNA-30c serves as an independent biochemical recurrence predictor and potential tumor suppressor for prostate cancer," Molecular Biology Reports, vol. 41, No. 5, pp. 2779-2788, 2014.

Manoharan et al., "RNA interference and chemically modified small interfering RNAs," Current Biology in Chemical Biology, vol. 8, No. 6, pp. 570-579, 2004.

Nohata et al., "Tumor suppressive microRNA-375 regulates oncogene AEG-1/MTDH in head and neck squamous sell carcinoma (HNSCC)," Journal of Human Genetics, vol. 56, No. 8, pp. 595-601, 2011.

Saad et al., "Alcohol-dysregulated miR-30a and miR-934 in head and neck squamous cell carcinoma," Molecular Cancer, vol. 14, No. 181, 2015 (14 pages).

Shiah et al., "MIRNA-dependent regulation of DNA methyltransferose-3b in the retinoid acid metabolic genes during oral carcinogenesis," Proceeding of Annual Meeting of the Japanese Cancer Association, Abstract P-1125, vol. 73, 2014.

Stahlhut et al., "MicroRNAs and the cancer phenotype: profiling, signatures and clinical implications," Genome Medicine, 5: 111, 2013 (12 pages).

Syed et al., "miR-30 is downregulated in human squamous cell carcinoma and UVB exposed keratinocytes," Journal of Investigative Dermatology, Abstract 598, vol. 135, pp. S99-S105, 2015.

Tusher et al., "Significance analysis of microarrays applied to the ionizing radiation response," PNAS, vol. 98, No. 9, pp. 5116-5121, 2001.

Yan et al.,"The emerging role of miR-375 in cancer," International Journal of Cancer, vol. 135, No. 5, pp. 1011-1018, 2013.

Zhang et al., "Role of MicroRNA 30a Targeting Insulin Receptor Substrate 2 in Colorectal Tumorigenesis," Molecular and Cellular Biology, vol. 35, No. 6, pp. 988-1000, 2015.

Yu et al., "miR145 Targets the SOX9/ADAM17 Axis to Inhibit Tumor-Initiating Cells and IL-6-Mediated Paracrine Effects in Head and Neck Cancer," Cancer Research, vol. 73, No. 11, pp. 3425-3440, 2013.

Zhang et al., "MicroRNA-30a suppresses breast tumor growth and metastasis by targeting metadherin," Oncogene, vol. 33, No. 24, pp. 3119-3128, 2014.

Zhang et al., "Progress in microRNA delivery," Journal of Controlled Release, vol. 172, No. 3, pp. 962-974, 2013.

Ansseau et al., Antisense oligonucleotides used to target the DUX4 mRNA as therapeutic approaches in faciosscapulohumeral muscular dystrophy (FSHD), Genes, 2017, vol. 8, No. 93, p. 1-21.

Winkler et al., Oligonucleotides conjugates for therapeutic applications, Therapeutic Delivery, 2013, vol. 4, No. 7, p. 791-809.

* cited by examiner

Sequence (5' -> 3')

| SEQ ID NO: | | Name | Sequence |
|---|---|---|---|
| SEQ ID NO: 1 | Natural | miR-30a-5p | UGUAAACAUCCU-CGACUGGAAG |
| SEQ ID NO: 2 | | miR-30b-5p | UGUAAACAUCCU-ACACUC--AGCU |
| SEQ ID NO: 3 | | miR-30c-5p | UGUAAACAUCCU-ACACUCUCAGC |
| SEQ ID NO: 4 | | miR-30d-5p | UGUAAACAUCCC-CGACUGGAAG |
| SEQ ID NO: 5 | | miR-30e-5p | UGUAAACAUCCU-UGACUGGAAG |
| | | | |
| SEQ ID NO: 39 | Engineered | G007-30 | UGUAAACAUCCU CGACUGGAAG |
| SEQ ID NO: 38 | | G006-30 | UGUAAACAUCCU CGACUGGAA- |
| SEQ ID NO: 40 | | G061-30 | UGUAAACAUCC  CGACUGGAAG |
| SEQ ID NO: 41 | | G062-30 | UGUAAACAUCCU UGACUGGAAG |
| SEQ ID NO: 42 | | G063-30 | UGUAAACAUCC  UGACUGGAAG |
| SEQ ID NO: 43 | | G064-30 | UGUAAACAUCCU ACACUCUCAGC |
| SEQ ID NO: 44 | | G065-30 | UGUAAACAUCCU ACACUCUCAG- |
| SEQ ID NO: 45 | | G066-30 | UGUAAACAUCCU ACACUCUCA-- |

FIG. 1A

Sequence (5' -> 3')

| SEQ ID NO: | | Name | Sequence |
|---|---|---|---|
| SEQ ID NO: 6 | * | miR-30a-3p | CUUUCAGUC---GGAUGUUUGCAGC |
| SEQ ID NO: 51 | Engineered | P125-30 | --UUCAGUC---GGAUGUUUGCAGC |
| SEQ ID NO: 50 | | P005-30 | --UCCAGUC---GGAUGUUUACA-- |
| SEQ ID NO: 48 | | P003-30 | --UCCAGUCG-AGGAUGUUUACA-- |
| SEQ ID NO: 49 | | P004-30 | --UCCAGUCGCAGGAUGUUUACA-- |
| SEQ ID NO: 47 | | P002-30 | ---CCAGUCGCAGGAUGUUUACA-- |
| SEQ ID NO: 46 | | P001-30 | ---CCAGUCG-AGGAUGUUUACA-- |

*Natural

FIG. 1B

```
SEQ ID NO: 467   ITGA6 3'UTR:   5'-  UUC UAGUC       A   U    ACAAAAUAUAUUU         A       -3'
                                     ||| :||||                    |||||||
SEQ ID NO: 1     miR-30a-5p:    3'-  AAG-GUCAG                 ACAAAUGU-            -5'
                                              G            CUCCU--------

ΔG = -17.4 kcal/mol

A  UU  AG  U   UGACU          U
SEQ ID NO: 468   SERPINE1 3'UTR: 5'-  UU  GG  UG AGG        UGUUUAC     -3'
                                     ||  :|  || |||        |||||||
SEQ ID NO: 1     miR-30a-5p:     3'-  AA  UC  GC-UCC        ACAAAUG     -5'
                                      G   GG  A-      U----             U

ΔG = -17.5 kcal/mol

AGA         UU CAAC           C
SEQ ID NO: 469   EGFR 3'UTR:    5'-     CUGGUU  G     GUUUACA    -3'
                                        |::||:  |     |||||||
SEQ ID NO: 1     miR-30a-5p:    3'-     GGUCAG  C     CAAAUGU-   -5'
                                        GAA         CU CUA

ΔG = -15.5 kcal/mol

FIG. 2A

A   U    A  AAAUAUAUUU          A
SEQ ID NO: 467   ITGA6 3'UTR:   5'-  UUC UAGUC CA                UGUUACA    -3'
                                     ||| :|||| ||                |||||||
SEQ ID NO: 39    G007-30:       3'-  AAG-GUCAG GU              ACAAAUGU-   -5'
                                              G       C    CCU-------

ΔG = -19.0 kcal/mol

A  UU  AG       UGACU          U
SEQ ID NO: 468   SERPINE1 3'UTR: 5'-  UU  GG  UGUAGG        UGUUAC     -3'
                                      ||  :|  ||:|||        ||||||
SEQ ID NO: 39    G007-30:        3'-  AA  UC  GCGUCC        ACAAAUG    -5'
                                      G   GG  A-      U----             U

ΔG = -22.4 kcal/mol

AGA      UU   AC---           C
SEQ ID NO: 469   EGFR 3'UTR:    5'-     CUGGU  UGCA        GUUUACA    -3'
                                        |::||  :|||        |||||||
SEQ ID NO: 39    G007-30:       3'-     GGUCA--GCGU        CAAAUGU-   -5'
                                        GAA            CCUA

ΔG = -18.6 kcal/mol

FIG. 2B
```

```
miR-30a-5p:   5'-  UGUAAACAUCCUCGACUGGAAG-3'           SEQ ID NO: 1
                   ||:||||||||  |||||:|
              3'-CGACGUUUGUAGG--CUGACUU-5'             SEQ ID NO: 6

M30-025:      5'-uGuAaAcAuCcUGcGaCuGgA_ps a_ps G-3'    SEQ ID NO: 65
                 ||||||||||| |||||||
              3'-ACAUUUGUAGG---CUGACCU-5'-(Amino C6)   SEQ ID NO: 95

↓

M30-040:      5'-uGuAaAcAuCcUGcGaCuGgA_ps a_ps G-3'    SEQ ID NO: 65
                 |||||||||||| ||||||||
              3'-ACAUUUGUAGGA-GCUGACCU-5'-(Amino C6)   SEQ ID NO: 96

↓

M30-044:      5'-uGuAaAcAuCcUGcGaCuGgA_ps a_ps G-3'    SEQ ID NO: 65
                 ||||||||||||||||||||
              3'-ACAUUUGUAGGACGCUGACCU-5'-(Amino C6)   SEQ ID NO: 97
```

FIG. 7A
```
            SEQ ID NO: 69  G042-30:  5'-UGUAAACAUCCUCGACUGGAAG-3'
M30-033:                             ||||||||||| |||||||
            SEQ ID NO: 95  P014-30:  3'-ACAUUUGUAGG--CUGACCU-5'
            SEQ ID NO: 69  G042-30:  5'-UGUAAACAUCCUCGACUGGAAG-3'
M30-034:                             ||||||||||||||||||||
            SEQ ID NO: 96  P123-30:  3'-ACAUUUGUAGGAGCUGACCU-5'
            SEQ ID NO: 65  G032-30:  5'-UGUAAACAUCCUGCGACUGGAAG-3'
M30-040:                             ||||||||||| |||||||
            SEQ ID NO: 96  P123-30:  3'-ACAUUUGUAGGA-GCUGACCU-5'
```
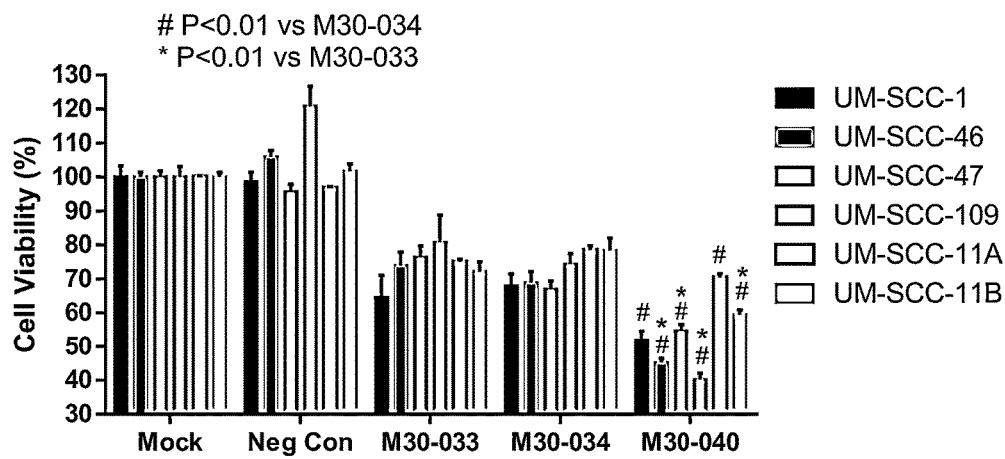
FIG. 7B
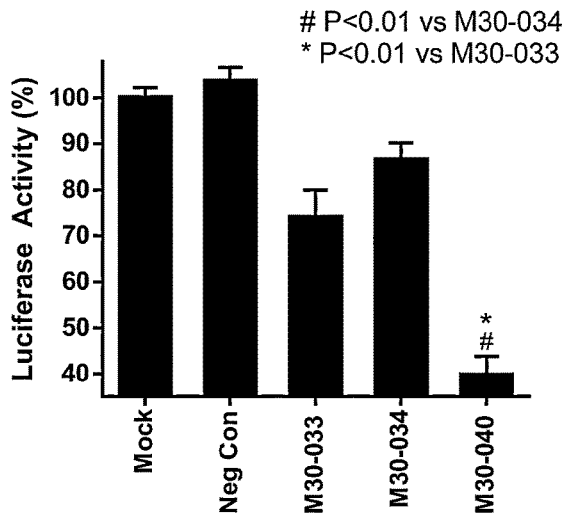
FIG. 7C

* P<0.01 vs M30-040

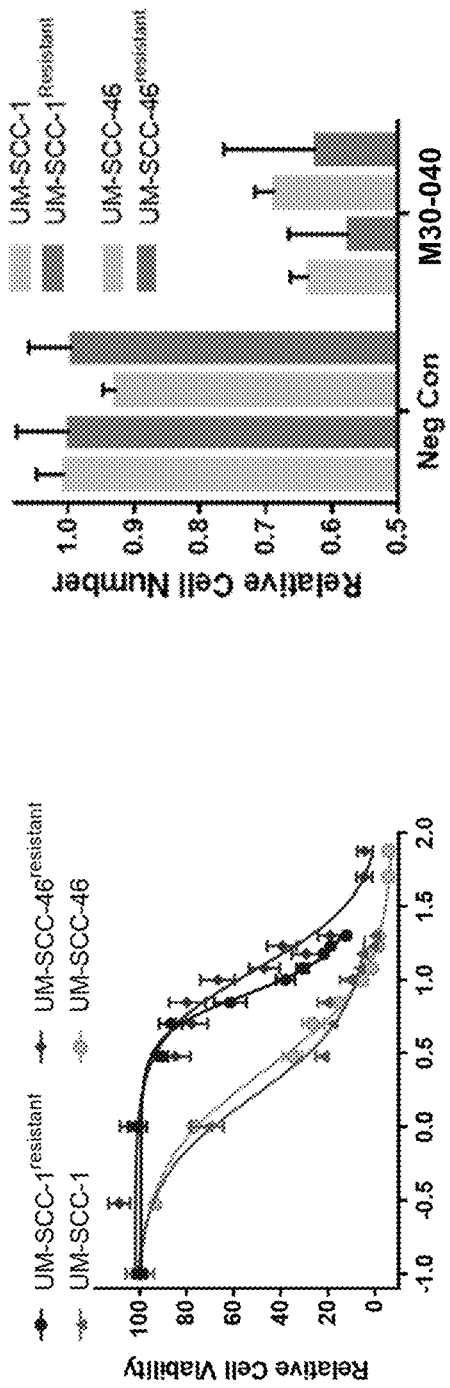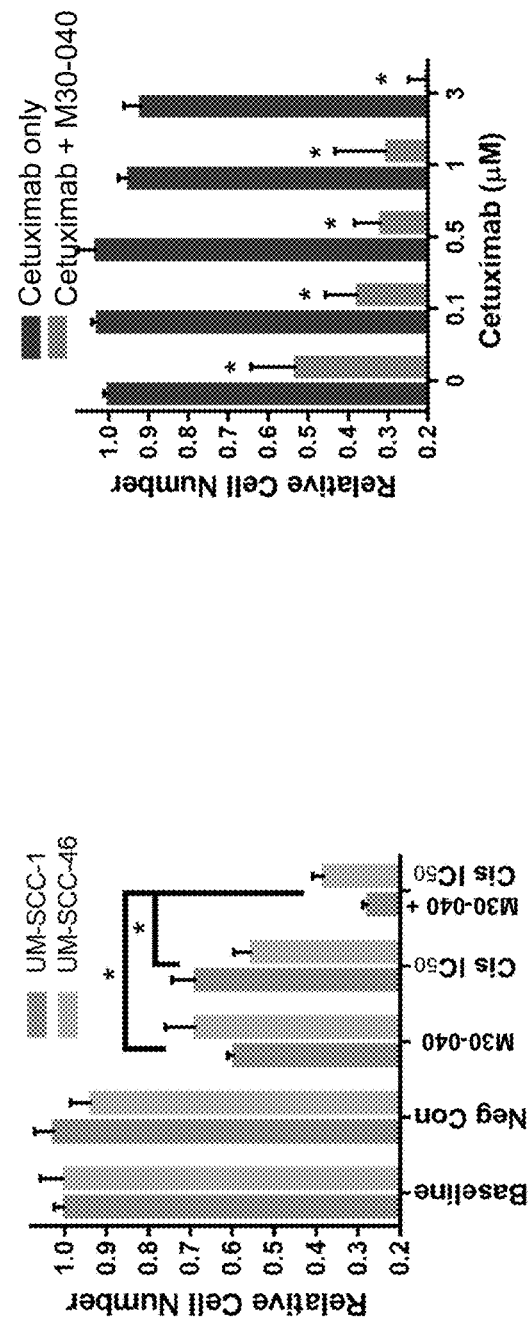
FIG. 12A
FIG. 12B
FIG. 12C
FIG. 12D

|  |  |  | Sequence (5' -> 3') |  |
|---|---|---|---|---|
| SEQ ID NO: 12 | Natural | miR-29a-3p | UAGCACCAU█UGAAAUCGGUUA | |
| SEQ ID NO: 13 | | miR-29b-3p | UAGCACCAUUUGAAAUC█GU██ | |
| SEQ ID NO: 14 | | miR-29c-3p | UAGCACCAUUUGAAAUCGGUUA | |
| SEQ ID NO: 102 | Engineered | G003-29 | UAGCACCAU█UGAAAUC█GU██ | Hybrid |
| SEQ ID NO: 101 | | G002-29 | UAGCACCAU█UGAAAUC█GU█- | |
| SEQ ID NO: 103 | | G004-29 | UAGCACCAUUUGAA█UC█GU██ | Mutation |
| SEQ ID NO: 118 | | G028-29 | UAGCACCAUUUGAA█UC█GU█- | |
| SEQ ID NO: 112 | | G022-29 | UAGCACCAUUUGAAA█C█GU██ | |
| SEQ ID NO: 111 | | G021-29 | UAGCACCAUUUGAAA█C█GU█- | |
| SEQ ID NO: 115 | | G025-29 | UAGCACCAUUUGAA██C█GU█- | |
| SEQ ID NO: 119 | | G029-29 | UAGCACCAUUUGAAA█UC█GU██ | Insert. |
| SEQ ID NO: 120 | | G030-29 | UAGCACCAUUUGAAA█UC█GU-- | |
| SEQ ID NO: 117 | | G027-29 | UAGCACCAUUUGAA██UC█GU██ | Mut. + Insert. |
| SEQ ID NO: 116 | | G026-29 | UAGCACCAUUUGAA██UC█GU-- | |
| SEQ ID NO: 105 | | G006-29 | UAGCACCAU█UGAA█UC█GU██ | Hybrid + Mut. +insert. |
| SEQ ID NO: 110 | | G020-29 | UAGCACCAU█UGAA██UC█GU██ | |
| SEQ ID NO: 109 | | G019-29 | UAGCACCAU█UGAA██C█GU██ | |
| SEQ ID NO: 100 | | G001-29 | UAGCACCAU█UGAAA█C█GU██ | |

FIG. 15

```
                                    U      GU
              5'-GCUGGUUUCA AUGGUG     UUAGA-3'  SEQ ID NO: 16
miR-29b-1:       :|||:||||| ||||||     :||
              3'-UUGUGACUAAAGU UACCAC     GAU-5'  SEQ ID NO: 13
                              U           --

U      GU
      (Amino C6)-5'-GCUGGUUUCA AUGGUG     UUA-3'  SEQ ID NO: 170
M29-004:             :|||:||||| ||||||     :||
              3'-UUGUGACUAAAGU UACCAC     GAU-5'  SEQ ID NO: 13
                              U           --

(Amino C6)-5'-CACUGAUUUCAGAUGGUGUUA-3'  SEQ ID NO: 176
M29-012:            |||||||||||||||||||:||
              3'-UUGUGACUAAAGUCUACCACGAU-5'  SEQ ID NO: 102
```

```
           (Amino C6)-5'-ACUGAUUUCAGAUGGUGUUA-3'      SEQ ID NO:173
M29-024:                 ||||||||||:|||||||:||
                      3'-UuGuGaCuAaAgUuUaCcAcGaU-5'  SEQ ID NO:127

GU
           (Amino C6)-5'-GCUGGUUUCAGAUGGUG  UUA-3'   SEQ ID NO:171
M29-026:                  :|||:|||||:||||||    :||
                      3'-UuGuGaCuAaAgUuUaCcAc  GaU-5' SEQ ID NO:127

(Amino C6)-5'-CACUGAUUUCAGAUGGUGUUA-3'    SEQ ID NO:176
M29-028:                  |||||||||||||||||||:||
                      3'-UuGuGaCuAaAgUcUaCcAcGaU-5'  SEQ ID NO:128
```

```
                              UUU
               5'-  ACUGAUUUC     UGGUGUUAG-3'   miR-29a-5p   SEQ ID NO: 15
   miR-29a          ||:|||||||    |||||:||
               3'- AUUGGCUAAAG    ACCACGAU  -5'  miR-29a-3p   SEQ ID NO: 12
                              UCU

UUU
  (Amino C6)-5'-  ACCGAUUUC     UGGUGUUA-3'      P010-29      SEQ ID NO: 158
   M29-023        ||||||||      |||||:||
              3'- AUUGGCUAAAG   ACCACGAU-5'      miR-29a-3p   SEQ ID NO: 12
                              UCU (Amino C6)-5'- ACCGAUUUCAGAUGGUGUUA-3'         P009-29      SEQ ID NO: 175
   M29-002       |||||||||||||||||:||
             3'- AUUGGCUAAAGUCUACCACGAU-5'       miR-29a-3p   SEQ ID NO: 12
```

FIG. 20A

```
                        U     GU
              5'-  GCUGGUUUCA AUGGUG    UUAGA-3'  miR-29b-1-5p  SEQ ID NO: 16
   miR-29b-1        :|||:|||| ||||||     :||
              3'- UUGUGACUAAAGU UACCAC    GAU  -5' miR-29b-3p   SEQ ID NO: 13
                        U                --

(Amino C6)-5'-  ACUGAUUUCAGAUGGUGUUA-3'          P007-29      SEQ ID NO: 173
   M29-007        |||||||||:|||||||:||
             3'- UUGUGACUAAAGUUUACCACGAU-5'        miR-29b-3p   SEQ ID NO: 13

(Amino C6)-5'- CACUGAUUUCAGAUGGUGUUA-3'          P011-29      SEQ ID NO: 176
   M29-008       |||||||||||:|||||||:||
             3'- UUGUGACUAAAGUUUACCACGAU-5'        miR-29b-3p   SEQ ID NO: 13
```

FIG. 20B

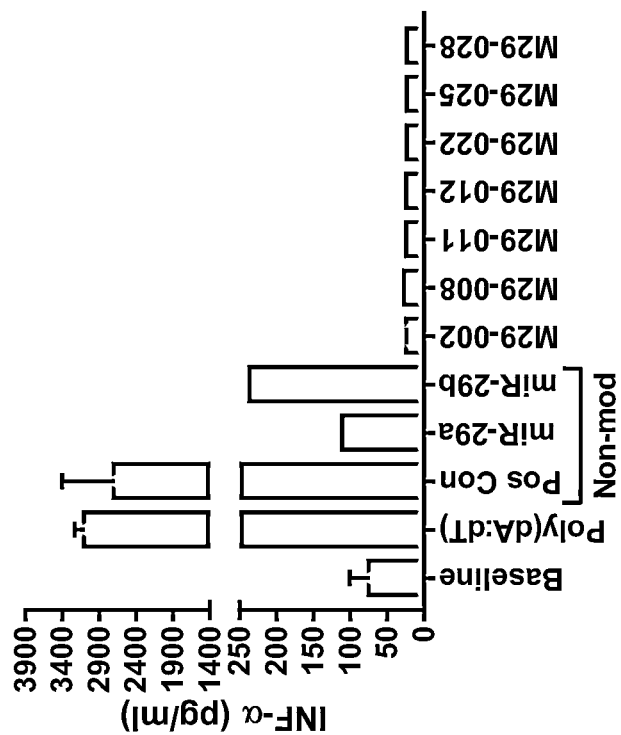
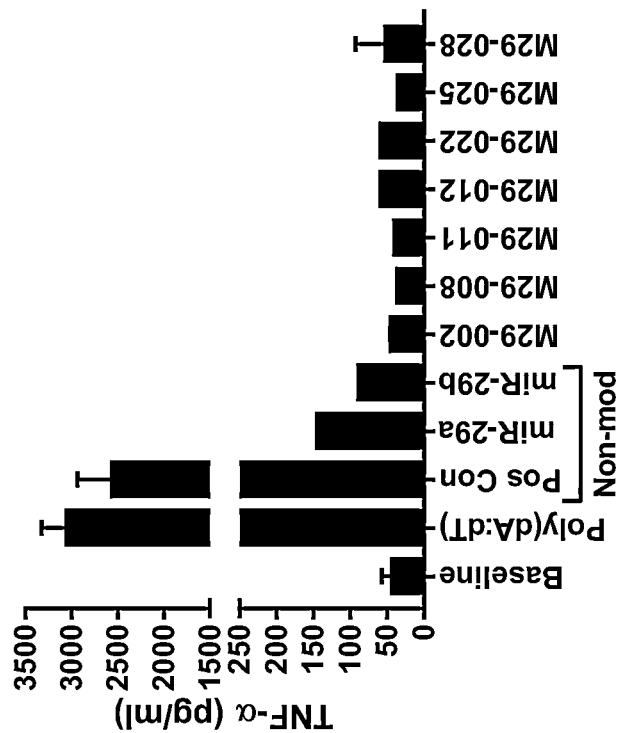
FIG. 21

```
HIV-1 NEF site:   5'-      UC        CC
                       CACUGA UUUGGA

```
                  UC         CC
HIV-1 NEF site: 5'-  CACUGA   UUUGGAUGGUGCUA  -3'   SEQ ID NO: 470
                     ||||||   ||::||||||||||
G003-29:        3'-  GUGACU  -AAGUCUACCACGAU  -5'   SEQ ID NO: 102
                  UU         A ΔG = -32.6 kcal/mol UC        A
HIV-1 NEF site: 5'-  CACUG   CCUUUGGAUGGUGCUA  -3'  SEQ ID NO: 470
                     |||||   ||||:::||||||||||
G031-29:        3'-  GUGAC  -GGAAGUUUACCACGAU  -5'  SEQ ID NO: 121
                  UU ΔG = -35.7 kcal/mol UC
HIV-1 NEF site: 5'-  CACUGACCUUUGGAUGGUGCUA  -3'    SEQ ID NO: 470
                     ||||||||||::||||||||||
G020-29:        3'-  GUGACUGGAAGUUUACCACGAU  -5'    SEQ ID NO: 110
                  UU ΔG = -43.4 kcal/mol
```

FIG. 22B

Calculated Free Energy Requirements for Target Recognition of Mimic Guide Strands to SARS Viral Transcript

| SEQ ID NO: | Guide Strand | Free energy (ΔG)* [kcal/mol] | | | | |
|---|---|---|---|---|---|---|
| | | 24077 | 19385 | 6114 | Net | Avg. |
| 12 | miR-29a-3p | -21.2 | -28.7 | -21.8 | -71.7 | -23.9 |
| 13 | miR-29b-3p | -23.1 | -27.2 | -22.2 | -72.5 | -24.2 |
| 102 | G003-29 | -22.9 | -29.7 | -21.8 | -74.4 | -24.8 |
| 103 | G004-29 | -24.9 | -27.5 | -21.3 | -73.7 | -24.6 |
| 112 | G022-29 | -28.9 | -28.2 | -22.4 | -79.5 | -26.5 |
| 115 | G025-29 | -28.9 | -28.8 | -22.1 | -79.8 | -26.6 |
| 119 | G029-29 | -25.1 | -28.1 | -24.4 | -77.6 | -25.9 |
| 117 | G027-29 | -25.1 | -28.1 | -24.1 | -77.3 | -25.8 |
| 105 | G006-29 | -25.3 | -30.0 | -20.3 | -75.6 | -25.2 |
| 110 | G020-29 | -25.5 | -30.6 | -23.1 | -79.2 | -26.4 |
| 109 | G019-29 | -29.3 | -31.4 | -21.1 | -81.8 | -27.3 |
| 100 | G001-29 | -29.3 | -30.7 | -21.4 | -81.4 | -27.1 |

*Free energy (ΔG) with cognate target sites at nucleotide positions 24077 (SEQ ID NO:476), 19385 (SEQ ID NO:481), and 6114 (SEQ ID 495) in the SARS genome were calculated using RNAhybrid 2.2.

FIG. 24A

| SEQ ID NO: | Guide Strand | Free energy (ΔG)* [kcal/mol] | | | | |
|---|---|---|---|---|---|---|
| | | 10840 | 19401 | 26687 | Net | Avg. |
| 86 | G129-30 | -18.4 | -17.9 | -22.0 | -58.3 | -19.4 |
| 88 | G132-30 | -16.1 | -19.1 | -23.5 | -58.7 | -19.6 |

*Free energy (ΔG) with cognate target sites at nucleotide positions 10840 (SEQ ID NO: 826), 19401 (SEQ ID NO: 827), and 26687(SEQ ID NO: 828) in the SARS genome were calculated using RNAhybrid 2.2.

FIG. 24B

Calculated Free Energy Requirements for Target Recognition of Mimic Guide Strands to SARS-CoV-2 Viral Transcript

| | | Free energy (ΔG)* [kcal/mol] | | | | |
|---|---|---|---|---|---|---|
| SEQ ID NO: | Guide Strand | 28648 | 19455 | 11350 | Net | Avg. |
| 12 | miR-29a-3p | -23.6 | -27.5 | -25.6 | -76.7 | -25.6 |
| 13 | miR-29b-3p | -24.4 | -26.4 | -26.0 | -76.8 | -25.6 |
| 102 | G003-29 | -23.7 | -28.9 | -27.8 | -80.4 | -26.8 |
| 103 | G004-29 | -29.4 | -27.5 | -26.6 | -83.5 | -27.8 |
| 112 | G022-29 | -23.7 | -29.0 | -27.3 | -80.0 | -26.7 |
| 115 | G025-29 | -27.8 | -28.9 | -27.4 | -84.1 | -28.0 |
| 119 | G029-29 | -27.0 | -26.8 | -26.8 | -80.6 | -26.9 |
| 117 | G027-29 | -29.0 | -27.8 | -28.4 | -85.2 | -28.4 |
| 105 | G006-29 | -28.7 | -30.0 | -28.4 | -87.1 | -29.0 |
| 110 | G020-29 | -28.3 | -30.3 | -28.6 | -87.2 | -29.1 |
| 109 | G019-29 | -27.1 | -32.2 | -30.2 | -89.5 | -29.8 |
| 100 | G001-29 | -23.3 | -31.5 | -29.1 | -83.9 | -28.0 |

*Free energy (ΔG) with cognate target sites at nucleotide positions 28648 (SEQ ID NO:500), 19455 (SEQ ID NO:513), and 11350 (SEQ ID NO:518) in the SARS-CoV-2 genome were calculated using RNAhybrid 2.2.

FIG. 25A

| | | Free energy (ΔG)* [kcal/mol] | | | | |
|---|---|---|---|---|---|---|
| SEQ ID NO: | Guide Strand | 10415 | 20344 | 26714 | Net | Avg. |
| 86 | G129-30 | -17.7 | -20.4 | -16.7 | -54.8 | -18.3 |
| 88 | G132-30 | -17.3 | -20.4 | -18.9 | -56.6 | -18.9 |

*Free energy (ΔG) with cognate target sites at nucleotide positions 10415 (SEQ ID NO: 829), 20344 (SEQ ID NO: 830), and 26714 (SEQ ID NO: 831) in the SARS-CoV2 genome were calculated using RNAhybrid 2.2.

FIG. 25B

Calculated Free Energy Requirements for Target Recognition of Mimic Guide Strands to HCV Genotype 1 Transcript

| SEQ ID NO: | Guide Strand | Free energy (ΔG)* [kcal/mol] | | | | |
|---|---|---|---|---|---|---|
| | | 3020 | 2791 | 240 | Net | Avg. |
| 12 | miR-29a-3p | -18.7 | -18.3 | -15.3 | -52.3 | -17.4 |
| 13 | miR-29b-3p | -19.0 | -21.5 | -16.2 | -56.7 | -18.9 |
| 102 | G003-29 | -18.6 | -19.7 | -16.0 | -54.3 | -18.1 |
| 103 | G004-29 | -19.0 | -24.7 | -17.3 | -61.0 | -20.3 |
| 112 | G022-29 | -19.0 | -24.8 | -15.2 | -59.0 | -19.7 |
| 115 | G025-29 | -19.8 | -24.0 | -17.5 | -61.3 | -20.4 |
| 119 | G029-29 | -19.0 | -21.7 | -17.5 | -58.2 | -19.4 |
| 117 | G027-29 | -19.0 | -23.9 | -17.9 | -60.8 | -20.3 |
| 105 | G006-29 | -18.6 | -22.5 | -17.1 | -58.2 | -19.4 |
| 110 | G020-29 | -18.6 | -23.5 | -17.5 | -59.6 | -19.9 |
| 109 | G019-29 | -20.0 | -21.0 | -19.9 | -60.9 | -20.3 |
| 100 | G001-29 | -18.9 | -21.3 | -14.9 | -55.1 | -18.4 |

*Free energy (ΔG) with cognate target sites at nucleotide positions 3020 (SEQ ID NO:587), 2791 (SEQ ID NO:588), and 240 (SEQ ID NO:589) in HCV Genotype 1 genome were calculated using RNAhybrid 2.2.

FIG. 26

TARGETED INHIBITION USING ENGINEERED OLIGONUCLEOTIDES

CROSS-REFERENCE TO RELATED APPLICATIONS(S)

This application is a Continuation Application of International Application No. PCT/US2021/025639, filed on Apr. 2, 2021, which claims the benefit U.S. Provisional Application No. 63/004,045, filed Apr. 2, 2020, the disclosures of which are incorporated herein by reference in their entirety.

STATEMENT OF GOVERNMENT SUPPORT

This invention was made with Government support under Grant No. U43CA221567 awarded by the National Cancer Institute and support from SBIR Contract No. HHSN272201800034C awarded by the National Institute of Allergy and Infection Disease. The Government has certain rights in the invention.

SUMMARY

Disclosed herein are engineered oligonucleotides or salts thereof that can comprise a polynucleotide sequence. In some embodiments, an engineered oligonucleotide or salt thereof can be at least partially complementary to at least a portion of at least a first and a second RNA originating from two genetic loci that are associated with a disease or condition. In some embodiments, when an engineered oligonucleotide or salt thereof at least partially binds to a first RNA: a first region of at least seven contiguous bases in the engineered oligonucleotide can be complementary to contiguous nucleic acids contained within the first RNA and a second region of at least five contiguous bases in the engineered oligonucleotide can be complementary to contiguous nucleic acids contained within the first RNA. In some embodiments, when an engineered oligonucleotide or salt thereof at least partially binds to a second RNA: a first region of at least seven contiguous bases in the engineered oligonucleotide can be complementary to contiguous nucleotides contained within a second RNA, and a second region of at least five contiguous bases in the engineered oligonucleotide can be complementary to contiguous nucleotides contained within the second RNA. In some embodiments, a predicted Gibbs free energy ($\Delta G$) of binding of an engineered oligonucleotide to a first and a second RNA can range, individually, from about −17 to about −36 kcal mol$^{-1}$ at about 37 degrees Celsius and at a pH ranging from about 7.2 to about 7.6. In some embodiments, an engineered oligonucleotide or salt thereof can be an antisense oligonucleotide, a synthetic microRNA (miRNA), or a small interfering RNA (siRNA). In some embodiments, an engineered oligonucleotide or salt thereof can comprise one or more nucleotide insertions, nucleotide deletions, nucleotide substitutions, or any combination thereof, relative to one or more otherwise comparable non-coding RNAs (ncRNAs). In some embodiments, an engineered oligonucleotide or salt thereof, when at least partially bound to the first or the second RNA, can have an at least about 10% lower Gibbs free energy ($\Delta G$) of binding at about 37 degrees Celsius and at a pH ranging from about 7.2 to about 7.6, relative to a $\Delta G$ of binding of the otherwise comparable ncRNA binding to the first or the second RNA at about 37 degrees Celsius and at a pH ranging from about 7.2 to about 7.6. In some embodiments, an engineered oligonucleotide or salt thereof can be from about 5 to about 50 nucleotides in length. In some embodiments, an engineered oligonucleotide or salt thereof can comprise a ribose sugar. In some embodiments, an engineered oligonucleotide or salt thereof can comprise a deoxyribose sugar. In some embodiments, an ncRNA can be an miR-30 micro RNA (miRNA), an miR-29 miRNA, an miR-26 miRNA, an miR-27 miRNA, an miR-101 miRNA, an miR-145 miRNA, an miR-205 miRNA, an miR-338 miRNA, or an miR-375 miRNA. In some embodiments, an engineered oligonucleotide or salt thereof can have at least 90% sequence identity to any one of SEQ ID NO: 1, SEQ ID NO: 2, SEQ ID NO: 3, SEQ ID NO: 4, SEQ ID NO: 5, SEQ ID NO: 12, SEQ ID NO: 13, SEQ ID NO: 14, SEQ ID NO: 19, SEQ ID NO: 20, SEQ ID NO: 24, SEQ ID NO: 25, SEQ ID NO: 28, SEQ ID NO: 30, SEQ ID NO: 32, SEQ ID NO: 34, SEQ ID NO: 36, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 465, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 634, SEQ ID NO: 635, SEQ ID NO: 636, SEQ ID NO: 637, SEQ ID NO: 638, SEQ ID NO: 639, SEQ ID NO: 640, SEQ ID NO: 641, SEQ ID NO: 642, SEQ ID NO: 643, SEQ ID NO: 840, SEQ ID NO: 841, SEQ ID NO: 842, SEQ ID NO: 843, SEQ ID NO: 844, SEQ ID NO: 845, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, SEQ ID NO: 915, SEQ ID NO: 916, SEQ ID NO: 917, SEQ ID NO: 918, SEQ ID NO: 919, SEQ ID NO: 920, SEQ ID NO: 921, SEQ ID NO: 922, SEQ ID NO: 923, SEQ ID NO: 924, SEQ ID NO: 925, SEQ ID NO: 926, SEQ ID NO: 927, SEQ ID NO: 928, SEQ ID NO: 929, SEQ ID NO: 930, SEQ ID NO: 931, SEQ ID NO: 932, SEQ ID NO: 933, SEQ ID NO: 934, SEQ ID NO: 935, SEQ ID NO: 936, SEQ ID NO: 937, SEQ ID NO: 938, SEQ ID NO: 939, SEQ ID NO: 940, SEQ ID NO: 941, SEQ ID NO: 942, SEQ ID NO: 943, SEQ ID NO: 944, SEQ ID NO: 945, SEQ ID NO: 946, SEQ ID NO: 947, SEQ ID NO: 948, or SEQ ID NO: 949, as determined by a BLAST pairwise sequence alignment algorithm. In some embodiments, an engineered oligonucleotide can form a secondary structure comprising a stem-loop in an aqueous solution at a temperature ranging from about 15 degrees Celsius to about 37 Celsius at a pH ranging from about 6.5 to about 7.6. In some embodiments, an engineered oligonucleotide or salt thereof can comprise a chemically modified base, chemically modified sugar, chemically modified backbone or phosphate linkage, or any combination thereof relative to a naturally occurring base, sugar, backbone, or phosphate linkage. In some embodiments, a chemical modification can be selected from the group consisting of: a methyl group, a fluoro group, a methoxyethyl group, an ethyl group, a hydroxymethyl group, a formyl group, bridged nucleic acid, locked nucleic acid, a carboxylic acid or salt thereof, a phosphothioate modified backbone, a methylphosphonate modified backbone, an amino-alkyl chain modification, and any combination thereof. In some embodiments, an engineered oligonucleotide or salt thereof, when chemically modified, can comprises the formula: $(N)_a(mN)_b(N)_cNN$; $(N)_a(mN)_b(N)_csfNsmN$; or $(fNmN)_h(mN)_i(fNmN)_jsfNsmN$; wherein each N can be independently uracil, guanine, adenine, cytosine, or other natural nucleotide; each mN can be independently a 2'-O-methyl-modified uracil, guanine, adenine, or cytosine; each s can be independently a phosphothioate-modified backbone; each fN can be independently 2'fluoro-modified uracil, guanine, adenine, or cytosine; and each a can be from 8-10, each b can be from 7-10, each c can be from 2-4, each h can be from 5-7, each i can be 0 or 1, and each j can be from 3-4. In some embodiments, an engineered oligonucleotide or salt thereof can have at least 90% sequence identity to any one of SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 391, SEQ ID NO: 392, SEQ ID NO: 393, SEQ ID NO: 394, SEQ ID NO: 395, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 412, SEQ ID NO: 413, SEQ ID NO: 414, SEQ ID NO: 415, SEQ ID NO: 416, SEQ ID NO: 417, SEQ ID NO: 418, SEQ ID NO: 419, SEQ ID NO: 420, SEQ ID NO: 421, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 437, SEQ ID NO: 438, SEQ ID NO: 439, SEQ ID NO: 440, SEQ ID NO: 441, SEQ ID NO: 442, SEQ ID NO: 443, SEQ ID NO: 445, SEQ ID NO: 446, SEQ ID NO: 447, SEQ ID NO: 448, SEQ ID NO: 449, SEQ ID NO: 450, SEQ ID NO: 451, SEQ ID NO: 452, SEQ ID NO: 453, SEQ ID NO: 455, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 620, SEQ ID NO: 644, SEQ ID NO: 645, SEQ ID NO: 646, SEQ ID NO: 647, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, SEQ ID NO: 664, SEQ ID NO: 665, SEQ ID NO: 666, SEQ ID NO: 667, SEQ ID NO: 668, SEQ ID NO: 669, SEQ ID NO: 670, SEQ ID NO: 671, SEQ ID NO: 672, SEQ ID NO: 673, SEQ ID NO: 674, SEQ ID NO: 675, SEQ ID NO: 676, SEQ ID NO: 677, SEQ ID NO: 678, SEQ ID NO: 679, SEQ ID NO: 680, SEQ ID NO: 681, SEQ ID NO: 682, SEQ ID NO: 683, SEQ ID NO: 684, SEQ ID NO: 685, SEQ ID NO: 686, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO:

700, SEQ ID NO: 701, SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, SEQ ID NO: 723, SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, SEQ ID NO: 754, SEQ ID NO: 755, SEQ ID NO: 756, SEQ ID NO: 757, SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, SEQ ID NO: 776, SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, SEQ ID NO: 788, SEQ ID NO: 789, SEQ ID NO: 790, SEQ ID NO: 791, SEQ ID NO: 792, SEQ ID NO: 793, SEQ ID NO: 794, SEQ ID NO: 795, SEQ ID NO: 796, SEQ ID NO: 797, SEQ ID NO: 798, SEQ ID NO: 799, SEQ ID NO: 800, SEQ ID NO: 801, SEQ ID NO: 802, SEQ ID NO: 803, SEQ ID NO: 804, SEQ ID NO: 805, SEQ ID NO: 806, SEQ ID NO: 807, SEQ ID NO: 808, SEQ ID NO: 809, SEQ ID NO: 810, SEQ ID NO: 811, SEQ ID NO: 812, SEQ ID NO: 813, SEQ ID NO: 814, SEQ ID NO: 815, SEQ ID NO: 816, SEQ ID NO: 817, SEQ ID NO: 818, SEQ ID NO: 819, SEQ ID NO: 820, SEQ ID NO: 821, SEQ ID NO: 822, SEQ ID NO: 823, SEQ ID NO: 824, SEQ ID NO: 825, SEQ ID NO: 835, SEQ ID NO: 836, SEQ ID NO: 837, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, SEQ ID NO: 859, SEQ ID NO: 860, SEQ ID NO: 861, SEQ ID NO: 862, SEQ ID NO: 863, SEQ ID NO: 864, SEQ ID NO: 865, SEQ ID NO: 866, SEQ ID NO: 867, SEQ ID NO: 868, SEQ ID NO: 869, SEQ ID NO: 870, SEQ ID NO: 871, SEQ ID NO: 872, SEQ ID NO: 873, SEQ ID NO: 874, SEQ ID NO: 875, SEQ ID NO: 876, SEQ ID NO: 877, SEQ ID NO: 878, SEQ ID NO: 879, SEQ ID NO: 880, SEQ ID NO: 881, SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, or SEQ ID NO: 899, as determined by a BLAST pairwise sequence alignment algorithm. In some embodiments, an engineered oligonucleotide sequence can comprise the sugar, base, or backbone modification. In some embodiments, a modification can comprise a linker. In some embodiments, a linker can be a covalent linker. In some embodiments, a linker can be a cleavable linker. In some embodiments, a linker can be further modified to comprises a conjugate. In some embodiments, a conjugate can be an antibody, a naturally occurring ligand, a small molecule, or a peptide. In some embodiments, a conjugate can be a drug or salt thereof. In some embodiments, an engineered oligonucleotide can comprise a base of a nucleotide that is glycosylated with a glycan. In some embodiments, the first or the second RNA can at least partially comprise an mRNA sequence. In some embodiments, an engineered oligonucleotide or salt thereof, when contacted with the mRNA sequence, can produce at least about a 1.2-fold lower expression of a polypeptide encoded by the mRNA sequence, as compared to contacting an equivalent amount of the ncRNA with the mRNA sequence; as determined by: (a) transfecting the engineered oligonucleotide or salt thereof into a first isolated mammalian cell comprising the mRNA sequence, (b) transfecting the ncRNA into a second isolated mammalian cell comprising the mRNA sequence, and (c) measuring an amount of the polypeptide expressed in the first isolated mammalian cell and the second isolated mammalian cell, wherein the first isolated mammalian cell and the second isolated mammalian cell are of the same type of mammalian cell. In some embodiments, an engineered oligonucleotide or salt thereof, when contacted with the mRNA sequence, can produce at least about a 1.2-fold lower activity of a polypeptide encoded by the mRNA sequence, as compared to contacting an equivalent amount of the ncRNA with the mRNA sequence; as determined by: (a) transfecting the engineered oligonucleotide or salt thereof into a first isolated mammalian cell comprising the mRNA sequence, (b) transfecting the ncRNA into a second isolated mammalian cell comprising the mRNA sequence, and (c) measuring an amount of activity from the polypeptide expressed in the first isolated mammalian cell and the second isolated mammalian cell, wherein the first isolated mammalian cell and the second isolated mammalian cell are of the same type of mammalian cell. In some embodiments, an engineered oligonucleotide or salt thereof when contacted with the mRNA sequence can produce from about 1.2-fold to about 10-fold lower expression of the polypeptide encoded by the mRNA sequence, as compared to contacting the equivalent amount of the ncRNA; as determined by: (a) transfecting the engineered oligonucleotide or salt thereof into the first isolated mammalian cell comprising the mRNA sequence, (b) transfecting the ncRNA into the second isolated mammalian cell comprising the mRNA sequence, and (c) measuring the amount of the polypeptide expressed in the first isolated mammalian cell and the second isolated mammalian cell. In some embodiments, an engineered oligonucleotide or salt thereof when contacted with the mRNA sequence can produce from about 1.2-fold to about 10-fold lower activity of the polypeptide encoded by the mRNA sequence, as compared to contacting the equivalent amount of the ncRNA; as determined by: (a) transfecting the engineered oligonucleotide or salt thereof into the first isolated mammalian cell comprising the mRNA sequence, (b) transfecting the ncRNA into the second isolated mammalian cell comprising the mRNA sequence, and (c) measuring the amount of activity from the polypeptide expressed in the first isolated mammalian cell and the second isolated mammalian cell. In some embodiments, a first isolated mammalian cell and second isolated mammalian cell can be a human cell or a mouse cell. In some embodiments, a first isolated mammalian cell can be a human cell, wherein the human cell can be a cancer cell, a fibroblast, a leukocyte, an epithelial cell, a squamous cell, a myoblast, a muscle cell In some embodiments, at least about 80% of an initial amount of the engineered oligonucleotide or salt thereof can remain when the engineered oligonucleotide or salt thereof is stored in a closed container stored for a time period of at least about 1 month at about 23 degrees Celsius with a relative atmospheric humidity of about 50%. In some embodiments, a time period can be from about 1 month to about 1 year. In some embodiments, a disease or condition can comprise a cancer. In some embodiments, at least a portion of the first or the second RNA can be encoded by an oncogene. In some embodiments, an oncogene can comprise ABL1, ABL2, AKT1, AKT2, AKT3, ATF1, BCL11A, BCL2, BCL3, BCL6, BCR, BRAF, CARD11, CBLB, CBLC, CCND1, CCND2, CCND3, CDX2, CTNNB1, DDB2, BBIT3, BBX6, DEK, EGFR, ELK4, ERBB2, ERBB3, E2F1, ZEB1, ETV4, ETV6, EV11, EWSR1, FEV, FGFR1, FGFR1OP, FGR2, FUS, GOLGA5, GOPC, HMGA1, HMGA2, HRAS, IRF4, ITGA6, JUN, KIT, KRAS, LCK, LMO2, MAF, MAFB, MAML2, MDM2, MET, MITF, MLL, MPL, MYB, MYC, MYCL1, MYCN, NCOA4, NFKB2, NRAS, NTRK1, NUP214, PAX8, PDGFB, PIK3CA, PIM1, PLAG1, PPARG, PTPN11, RAF1, REL, RET, ROS1, SETDB1, SERPINE1, SMO, SS18, TCL1A, TET2, TFG, CDK6, ATG9A, TLX1, TPR, USP6, CSNK1G, KLF17, ARHGAP26, RAB11FIP1, RBJ, SERBP1, CTBP1, CRKL, ITGA3, ITGAV, LAMC1, G6PC2, PPP2R5E or any combination thereof. In some embodiments, an oncogene can comprise ITGA6, BCL2, DEK, PLAG1, SERPINE1, MYCN, LMO2, PIM1, EGFR, IRS1, NT5E, GLDC, SOCS1, STAT1, LOX, PDGFRB, WNT5A, CD80, CCNA1, THBS2, IGF1R, AFAP1L2, CTHRC1, MET, FAP, IL1A, GJA1, MYBL2, or any combination thereof. In some embodiments, an engineered oligonucleotide or salt thereof can be selective for an RNA sequence encoding ITGA6, SERPINE1, EGFR, MDTH or any combination thereof, among a plurality of RNA sequences. In some embodiments, a disease or condition can comprise fibrosis. In some embodiments, at least a portion of the first or the second RNA can be encoded by a collagen super family gene, a platelet-derived growth factor gene, a TGF-β signaling gene, a collagen remodeling gene, an extracellular matrix remodeling gene, a Wnt signaling gene, a hepatoma-derived growth factor (HDGF) signaling gene, or any combination thereof. In some embodiments, at least a portion of an first or the second RNA can be encoded by the collagen super family gene, wherein the collagen super family gene is selected from the group consisting of: COL1A1, COL11A1, COL2A1, COL5A3, COL5A2, COL4A4, COL21A1, COL7A1, COL9A1, COL19A1, COL5A1, COL22A1, COL8A1, COL4A2, COL6A2, COL24A1, COL4A3, COL4A6, COL25A1, COL16A1, COL15A1, and any combination thereof. In some embodiments, at least a portion of the first or the second RNA is encoded by the platelet-derived growth factor gene, wherein the platelet-derived growth factor gene can be selected from the group consisting of: PDGFB, PDGFC, PDGFRB, and any combination thereof. In some embodiments, at least a portion of the first or the second RNA can be encoded by the TGF-β signaling gene, wherein the TGF-β signaling gene is WISP1, TGFB2, or any combination thereof. In some embodiments, at least a portion of the first or the second RNA can be encoded by the collagen remodeling gene, wherein the collagen remodeling gene is LOXL2. In some embodiments, at least a portion of the first or the second RNA can be encoded by the extracellular matrix remodeling gene, wherein the extracellular matrix remodeling gene is selected from the group consisting of: COL1A1, COL11A1, COL2A1, COL5A3, COL5A2, COL4A4, COL21A1, COL7A1, COL9A1, COL19A1, COL5A1, COL22A1, COL8A1, COL4A2, COL6A2, COL24A1, COL4A3, COL4A6, COL25A1, COL16A1, COL15A1, LOXL2, Elastin, and any combination thereof. In some embodiments, at least a portion of the first or the second RNA can be encoded by the Wnt signaling gene, wherein the Wnt signaling gene comprises WISP1. In some embodiments, at least a portion of the first or the second RNA can be encoded by the HDGF signaling gene, wherein the HDGF signaling gene comprises HDGF. In some embodiments, the disease or condition can comprise a viral infection. In some embodiments, the viral infection can be an HCV Genotype 1 infection. In some embodiments, at least a portion of the first or the second RNA can be encoded in an HCV Genotype 1 genome. In some embodiments, the first or the second RNA can comprise at least about 90% sequence identity to SEQ ID NO: 587, SEQ ID NO: 588, or SEQ ID NO: 589, as determined by a BLAST pairwise sequence alignment algorithm. In some embodiments, the viral infection can be a coronavirus infection. In some embodiments, the coronavirus can be SARS-CoV-2. In some embodiments, at least a portion of the first or the second RNA can be encoded in a SARS-CoV-2 genome. In some embodiments, the first or the second RNA can comprise at least about 90% sequence identity to any one of SEQ ID NO: 500 to SEQ ID NO: 531, SEQ ID NO: 829, SEQ ID NO: 830, or SEQ ID NO: 831. In some embodiments, the first or the second RNA can comprise at least about 90% sequence identity to SEQ ID NO: 500, SEQ ID NO: 513, or SEQ ID NO: 518, as determined by a BLAST pairwise sequence alignment algorithm. In some embodiments, the coronavirus can be SARS-CoV. In some embodiments, at least a portion of the first or the second RNA can be encoded in a SARS-CoV genome. In some embodiments, the first or the second RNA can comprise at least about 90% sequence identity to any one of SEQ ID NO: 474 to SEQ ID NO: 499, SEQ ID NO: 826, SEQ ID NO: 827, or SEQ ID NO: 828. In some embodiments, the first or the second RNA can comprise at least about 90% sequence identity to SEQ ID NO: 476, SEQ ID NO: 481, or SEQ ID NO: 495, as determined by a BLAST pairwise sequence alignment algorithm. In some embodiments, the coronavirus can be MERS-CoV. In some embodiments, at least a portion of the first or the second RNA can be encoded in a MERS-CoV genome. In some embodiments, the first or the second RNA can comprise at least about 90% sequence identity to any one of SEQ ID NO: 532 to SEQ ID NO: 554. In some embodiments, the coronavirus can be CoV-HKU1. In some embodiments, at least a portion of the first or the second RNA can be encoded in a CoV-HKU1 genome. In some embodiments, the first or the second RNA can comprise at least about 90% sequence identity to any one of SEQ ID NO: 555 to SEQ ID NO: 586. In some embodiments, the viral infection can be an HIV infection. In some embodiments, at least a portion of the first or the second RNA can be encoded by an HIV genome. In some embodiments, the first or the second RNA can comprise at least about 90% sequence identity to SEQ ID NO: 470, as determined by a BLAST pairwise sequence alignment algorithm. In some embodiments, the first or the second RNA can comprise at least about 90% sequence identity to SEQ ID NO: 471, SEQ ID NO: 472, or SEQ ID NO: 473, as determined by a BLAST pairwise sequence alignment algorithm. In some embodiments, the disease or condition can comprise a neuromuscular disorder including a muscular dystrophy or a myopathy. In some embodiments, the disease or condition can be a Duchenne's muscular dystrophy (DMD), Myotonic Dystrophy (MD), Facioscapulohumeral muscular dystrophy (FSHD), Limb-Girdle muscular dystrophy (LGMD), Becker muscular dystrophy, Oculopharyngeal muscular dystrophy, Emery-Dreifuss muscular dystrophy, or Distal muscular dystrophy. In some embodiments, the disease or condition can be caused by an inherited or spontaneous autosomal dominant mutation. In some embodiments, at least a portion of the first or the second RNA can be encoded in the dystrophin, DMPK, CLCN1, CNBP, D4Z4 repeat, DUX4, SMCHD1, DBET, SVIL, GAL3ST2, FRG1, CAPN3, DYSF, LMNA, PABPN1, PYGM, MYOD1, MYH7, HNRNPC, HNRNPA2B1, ACVR1, ASIC2, ATG14, ATP1A1, B3GTNL1, BANF1, BPTF, CASP8AP2, CDX4, CELF2, CHMP7, CKMT1B, CLASP1, CNOT3, COL15A1, CYP3A4, DCAF15, DCN, DLX5, DUSP7, DUX1, DUX5, EMILIN1, EPG5, FAM13A, FBX03, FBXL22, FMNL3, FREM2, FRMPD2, GADD45A, GID4, GJD3, GMPR, GNAT1, GOSR1, GPRC6A, HERC1, HGF, HOOK3, HOXC9, HSP40, IRF9, IRX5, ITGA10, ITGA3, ITGA9, KCNC3, KLHL3, KLK6, LARP6, MALT1, MAP3K4, MAPK10, MIR4661, MIR8078, MTSS1, NDUFAF6, NEBL, NKX2, NR2F1, PCID2, PDE10A, PKD1L2, PKHD1, PPP1R12B, PTPRN2, PYY, RABGAP1L, RBCK1, RFX3, RHBDF2, SCRIB, SEMA3B, SETD4, SHFL, SHH, SLC37A4, SLC9A8, SMAD1,
SPEF1, SPRED3, ST3GAL6, STAG1, SUPV3L1, TBC1D26, TCEA2, TCF3, TM6SF1, TMEM 108, TMEM259, TNFSF4, TNIP1, TRNP1, USH1G, WRNIP1, XIAP, ZNF574 gene or any combination thereof. In some embodiments, a first or the second RNA can comprise at least about 90% sequence identity to any one of SEQ ID NO: 901 to SEQ ID NO: 949, as determined by a BLAST pairwise sequence alignment algorithm. In some embodiments, at least one base of a nucleotide in the engineered oligonucleotide may not be complementary to the first or the second RNA.

Also disclosed herein are engineered oligonucleotides or salts thereof that can comprise a polynucleotide sequence of from about 5 nucleotides to about 50 nucleotides. In some embodiments, the engineered oligonucleotide or salt thereof can comprise: a first region, a second region that is adjacent to the first region, and a third region that is adjacent to the second region, wherein the regions are arranged from 5' to 3' in the following order: the first region, the second region, and the third region; wherein when the engineered oligonucleotide or salt thereof is bound to an mRNA sequence, the first region and the third region are complementary to the mRNA sequence and the second region comprises at least one base that is not complementary to the mRNA sequence. In some embodiments, the engineered oligonucleotide or salt thereof can comprise an at least about 10% lower Gibbs free energy ($\Delta G$) of binding, as determined for binding to the mRNA sequence at about 37 degrees Celsius and at about pH 7.2, relative to a $\Delta G$ of binding of an otherwise comparable oligonucleotide binding to the mRNA sequence at 37 degrees Celsius and at about pH 7.2, wherein the otherwise comparable oligonucleotide lacks the at least one base in the engineered oligonucleotide that is not complementary to the mRNA sequence.

Also disclosed herein are engineered oligonucleotides or salts thereof that can comprise a polynucleotide sequence with at least about 90% sequence identity to any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949, as determined by a BLAST pairwise sequence alignment algorithm, wherein the engineered oligonucleotide or salt thereof when contacted with an mRNA sequence produces at least about a 1.2-fold lower expression of a polypeptide encoded by the mRNA sequence, as compared to contacting an equivalent amount of an miR-29 or miR-30 oligonucleotide or salt thereof naturally present in a human cell; as determined by: (a) transfecting the engineered oligonucleotide or salt thereof into a first isolated human cell comprising the mRNA sequence, (b) transfecting the miR-29 or miR-30 oligonucleotide into a second isolated human cell comprising the mRNA sequence, and (c) measuring an amount of the polypeptide expressed in the first isolated human cell and the isolated second human cell. In some embodiments, the structure and chemistry can be optimized to impart greater than or equal to 100× stability to natural nucleases compared to an unmodified sequence or a comparable ncRNA.

Also disclosed herein are engineered passenger oligonucleotides or salts thereof that can comprise a polynucleotide sequence, wherein the engineered passenger oligonucleotide or salt thereof can be at least partially complementary to at least a portion of an engineered oligonucleotide or salt thereof as described herein. In some embodiments, an engineered passenger oligonucleotide or salt thereof can be from about 5 to about 50 nucleotides in length. In some embodiments, the engineered passenger oligonucleotide or salt thereof can comprise a ribose sugar. In some embodiments, the engineered passenger oligonucleotide or salt thereof can comprise a deoxyribose sugar. In some embodiments, the engineered passenger oligonucleotide or salt thereof can have at least 90% sequence identity to any one of SEQ ID NO: 6, SEQ ID NO: 7, SEQ ID NO: 8, SEQ ID NO: 9, SEQ ID NO: 10, SEQ ID NO: 11, SEQ ID NO: 15, SEQ ID NO: 16, SEQ ID NO: 17, SEQ ID NO: 18, SEQ ID NO: 21, SEQ ID NO: 22, SEQ ID NO: 23, SEQ ID NO: 26, SEQ ID NO: 27, SEQ ID NO: 29, SEQ ID NO: 31, SEQ ID NO: 33, SEQ ID NO: 35, SEQ ID NO: 37, SEQ ID NO: 46, SEQ ID NO: 47, SEQ ID NO: 48, SEQ ID NO: 49, SEQ ID NO: 50, SEQ ID NO: 51, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, or SEQ ID NO: 466, as determined by a BLAST pairwise sequence alignment algorithm. In some embodiments, the engineered passenger oligonucleotide can form a secondary structure comprising a stem-loop. In some embodiments, the engineered passenger oligonucleotide or salt thereof can comprise a chemically modified base, chemically modified sugar, chemically modified backbone or phosphate linkage, or any combination thereof relative to a naturally occurring base, sugar, backbone, or phosphate linkage. In some embodiments, the chemical modification can be selected from the group consisting of: a methyl group, a fluoro group, a methoxyethyl group, an ethyl group, a hydroxymethyl group, a formyl group, a carboxylic acid or salt thereof, a phosphothioate modified backbone, a methylphosphonate modified backbone, an amino-alkyl chain modification, and any combination thereof. In some embodiments, the engineered passenger oligonucleotide or salt thereof, when chemically modified, can comprise the formula: CAP-mNmNmN(N)$_k$mNmNmN; wherein CAP can be selected from a 5'-terminal methyl group (5'-OMethyl) or alkylamino group such as amino-carbon 6 chain (5'-Amino C6); each N can be independently uracil, guanine, adenine, or cytosine; each mN can be independently a 2'-O-methyl-modified uracil, guanine, adenine, or cytosine; and each k can be from 12-19. In some embodiments, the engineered passenger oligonucleotide or salt thereof can have at least 90% sequence identity to any one of SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 170, SEQ ID NO:

171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 202, SEQ ID NO: 203, SEQ ID NO: 204, SEQ ID NO: 223, SEQ ID NO: 224, SEQ ID NO: 234, SEQ ID NO: 244, SEQ ID NO: 444, SEQ ID NO: 454, SEQ ID NO: 464, SEQ ID NO: 838, SEQ ID NO: 839, or SEQ ID NO: 900, as determined by a BLAST pairwise sequence alignment algorithm. In some embodiments, the engineered passenger oligonucleotide or salt thereof can comprise a sugar modification. In some embodiments, the sugar modification can comprise a glycosylated base. In some embodiments, the structure and chemistry can be optimized to impart greater than or equal to 100× stability to natural nucleases compared to an unmodified sequence or a comparable ncRNA.

Also disclosed herein are nucleic acid constructs that can comprise: (a) a first strand comprising an engineered oligonucleotide or salt thereof as described herein and (b) a second strand comprising an engineered passenger oligonucleotide or salt thereof as described herein with a sequence complementary to at least a portion of the first strand.

Also disclosed herein are vectors that can comprise an engineered oligonucleotide or salt thereof as described herein or a nucleic acid construct as described herein. In some embodiments, the vector can be present in a liposome, a nanoparticle, or any combination thereof. In some embodiments, the vector can be a viral vector. In some embodiments, the viral vector can be an adeno-associated viral (AAV) vector.

Also disclosed herein are isolated cells that can comprise an engineered oligonucleotide or salt as described herein, a nucleic acid construct as described herein, or a vector as described herein.

Also disclosed herein are pharmaceutical compositions that can comprise: (a) an engineered oligonucleotide or salt thereof as described herein, a nucleic acid construct as described herein, or a vector as described herein; and (b) a pharmaceutically acceptable excipient, diluent, or carrier. In some embodiments, a pharmaceutical composition can be in unit dose form. In some embodiments, a pharmaceutical composition can be encapsulated. In some embodiments, a pharmaceutical composition can be in the form of a liquid.

Also disclosed herein are methods of treating a subject in need thereof that can comprise: administering to the subject a therapeutically effective amount of: an engineered oligonucleotide or salt thereof as described herein, a nucleic acid construct as described herein, a vector as described herein, or a pharmaceutical composition as described herein. In some embodiments, the administering can be by an intravenous injection, an intramuscular injection, an intrathecal injection, an intraorbital injection, a subcutaneous injection, or any combination thereof. In some embodiments, the administering can be oral, otic, ocular, rectal, or any combination thereof. In some embodiments, the method can further comprise a second administering comprising a second therapy to the subject. In some embodiments, the administering and the second administering can be concurrent. In some embodiments, the administering and the second administering can be sequential. In some embodiments, the subject can have or can be at risk of developing a disease or condition. In some embodiments, the disease or condition can be a cancer. In some embodiments, the cancer can be ahead cancer, a neck cancer, skin cancer, a cervical cancer, a prostate cancer, or any combination thereof. In some embodiments, the disease or condition can be a viral infection. In some embodiments, the viral infection can be a SARS-CoV infection, a SARS-COV-2 infection, a MERS-CoV infection, a CoV-HKU1 infection, an HIV infection, or an HCV infection. In some embodiments, the disease or condition can be a fibrosis. In some embodiments, the disease or condition can be muscular dystrophy. In some embodiments, the subject can be a mammal. In some embodiments, the mammal can be a human. In some embodiments, the subject may have been diagnosed with a disease or condition by a diagnostic test. In some embodiments, a diagnostic test can comprise an imaging procedure, a blood count analysis, a tissue pathology analysis, a biomarker analysis, or any combination thereof.

Also disclosed herein are methods that can comprise: contacting an engineered oligonucleotide or salt thereof as described herein, a nucleic acid construct as described herein, or a vector as described herein, with an isolated cell or an isolated tissue.

Also disclosed herein are as described herein kits that can comprise an engineered oligonucleotide or salt thereof as described herein in a container, a nucleic acid construct as described herein in a container, a vector as described herein in a container, or a pharmaceutical composition as described herein in a container.

INCORPORATION BY REFERENCE

All publications, patents, and patent applications mentioned in this specification are herein incorporated by reference to the same extent as if each individual publication, patent, or patent application was specifically and individually indicated to be incorporated by reference. To the extent publications and patents or patent applications incorporated by reference contradict the disclosure contained in the specification, the specification is intended to supersede and/or take precedence over any such contradictory material.

DESCRIPTION OF THE DRAWINGS

The novel features of exemplary embodiments are set forth with particularity in the appended claims. A better understanding of the features and advantages will be obtained by reference to the following detailed description that sets forth illustrative embodiments, in which the principles of exemplary embodiments are utilized, and the accompanying drawings of which:

FIG. 1A shows natural miR-30 guide strand sequences and examples of engineered family members.

FIG. 1B shows natural miR-30 passenger strand sequences and examples of engineered family members.

FIG. 2A shows free energy (ΔG) and hybridization between natural miR-30a-5p sequence and target sites in the 3'UTRs of ITGA6, SERPINE1, and EGFR transcripts.

FIG. 2B shows free energy (ΔG) and hybridization between engineered family G007-30 (SEQ ID NO: 39) containing the 'G' insertion at position 13 and the ITGA6, SERPINE1, and EGFR target sites.

FIG. 7A shows exemplar structure of engineered mimic duplexes with passenger strands sequence and chemical modifications which alter the mimic structure.

FIG. 7B shows anti-tumor activity of exemplar engineered miR-30 mimics in cancer cell lines.

FIG. 7C shows knock-down of a luciferase reporter by engineered miR-30 mimics with varied structure but identical guide strands.

FIG. 12A shows production of cisplatin resistant cancer cell lines.

FIG. 12B shows preservation of engineered miR-30 mimic activity in cisplatin resistant cancer cell lines.

FIG. 12C shows resensitization of resistance cell lines to cisplatin by engineered miR-30 mimic treatment.

FIG. 12D shows sensitization of cancer cell lines to EGFR inhibitor cetuximab by engineered miR-30 mimic treatment.

FIG. 15 shows natural miR-29 guide strand sequences and examples of engineered family members.

FIG. 20A shows sequence and structure of native miR-29a duplex and exemplar engineered miR-29a mimics.

FIG. 20B shows sequence and structure of native miR-29b duplex and exemplar engineered miR-29b mimics.

FIG. 21 shows engineered mimics of miR-29 display reduced innate immune stimulation.

FIG. 22A shows schematic visualization of an native and engineered miR-29-3p guide strands binding to HIV-1 NEF RNA.

FIG. 22B shows inhibition of HIV-1 replication by exemplar engineered miR-29 mimics.

FIG. 24A shows calculated free energy of binding to predicted target sites in the SARS-CoV viral genome by natural and engineered miR-29-3p guide strands.

FIG. 24B shows calculated free energy of binding to predicted target sites in the SARS-CoV viral genome by natural and engineered miR-30-5p guide strands.

FIG. 25A shows calculated free energy of binding to predicted target sites in the SARS-CoV-2 viral genome by natural and engineered miR-29-3p guide strands.

FIG. 25B shows calculated free energy of binding to predicted target sites in the SARS-CoV-2 viral genome by natural and engineered miR-30-5p guide strands.

FIG. 26 shows calculated free energy of binding to predicted target sites in the HCV-1 viral genome by natural and engineered miR-29-3p guide strands.

SEQUENCE LISTING

Figure 2C:
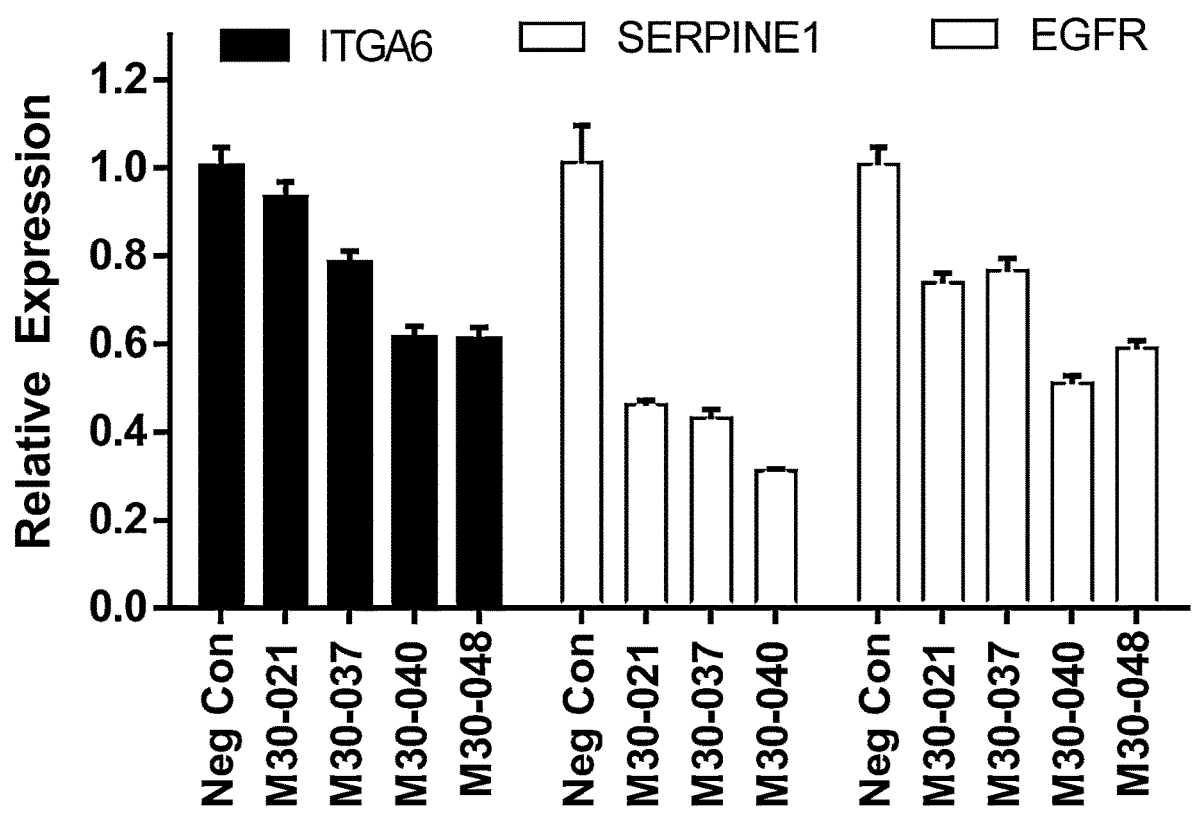
FIG. 2C shows that a mimic containing the same 'G' insertion at position 13 as found in G007-30 can demonstrate improved knockdown of select oncogenic targets.

Any nucleic acid and amino acid sequences listed herein or in the accompanying Sequence Listing are shown using standard letter abbreviations for nucleotide bases and amino acids, as defined in 37 C.F.R. 1.822.

SEQ ID NOs: 1-37 are the nucleotide sequences of exemplary mature miRNAs.

SEQ ID NOs: 38-45, 52-89, and 624-825 are modified miR-30 guide strand nucleotide sequences.

SEQ ID NOs: 46-51, 90-99, and 900 are modified miR-30 passenger strand nucleotide sequences.

SEQ ID NOs: 100-154, 620, and 835-837 are modified miR-29 guide strand nucleotide sequences.

SEQ ID NOs: 155-183 and 838-839 are modified miR-29 passenger strand nucleotide sequences.

SEQ ID NOs: 184-201 are modified miR-26 guide strand nucleotide sequences.

SEQ ID NOs: 202-204 are modified miR-26 passenger strand nucleotide sequences.

SEQ ID NOs: 205-222 are modified miR-27 guide strand nucleotide sequences.

SEQ ID NOs: 223-224 are modified miR-27 passenger strand nucleotide sequences.

SEQ ID NOs: 225-233 are modified miR-101 guide strand nucleotide sequences.

SEQ ID NOs: 234 is a modified miR-101 passenger strand nucleotide sequence.

SEQ ID NOs: 235-243 are modified miR-145 guide strand nucleotide sequences.

SEQ ID NOs: 244 is a modified miR-145 passenger strand nucleotide sequence.

SEQ ID NOs: 245-443 and 840-899 are modified miR-205 guide strand nucleotide sequences.

SEQ ID NOs: 444 is a modified miR-205 passenger strand nucleotide sequence.

SEQ ID NOs: 445-453 are modified miR-338 guide strand nucleotide sequences.

SEQ ID NOs: 454 is a modified miR-338 passenger strand nucleotide sequence.

SEQ ID NOs: 455-463 are modified miR-375 guide strand nucleotide sequences.

SEQ ID NOs: 464 is a modified miR-375 passenger strand nucleotide sequence.

SEQ ID NOs: 465 is an engineered guide strand nucleotide sequence.

SEQ ID NOs: 466 is an engineered passenger strand nucleotide sequence.

SEQ ID NOs: 901-949 are antisense nucleotide sequences.

SEQ ID NO: 467-619, 621-623, 826-834, 950-1120 are target nucleotide sequence.

DETAILED DESCRIPTION

Definitions

Unless otherwise indicated, open terms for example "contain," "containing," "include," "including," and the like mean comprising.

The singular forms "a", "an", and "the" are used herein to include plural references unless the context clearly dictates otherwise. Accordingly, unless the contrary is indicated, the numerical parameters set forth in this application are approximations that can vary depending upon the desired properties sought to be obtained.

As used herein, the term "about" or "approximately" can mean within an acceptable error range for the particular value as determined by one of ordinary skill in the art, which will depend in part on how the value is measured or determined, e.g., the limitations of the measurement system. For example, "about" can mean plus or minus 10%, per the practice in the art. Alternatively, "about" can mean a range of plus or minus 20%, plus or minus 10%, plus or minus 5%, or plus or minus 1% of a given value. Alternatively, particularly with respect to biological systems or processes, the term can mean within an order of magnitude, within 5-fold, or within 2-fold, of a value. Where particular values are described in the application and claims, unless otherwise stated the term "about" meaning within an acceptable error range for the particular value should be assumed. Also, where ranges and/or subranges of values are provided, the ranges and/or subranges can include the endpoints of the ranges and/or subranges.

The term "substantially" as used herein can refer to a value approaching 100% of a given value. In some cases, the term can refer to an amount that can be at least about 90%, 91%, 92%, 93%, 94%, 95%, 96%, 97%, 98%, 99%, 99.9%, or 99.99% of a total amount. In some cases, the term can refer to an amount that can be about 100% of a total amount.

The term "homology" can refer to a % identity of a sequence to a reference sequence. As a practical matter, whether any particular sequence can be at least 50%, 60%, 70%, 80%, 85%, 90%, 92%, 95%, 96%, 97%, 98% or 99% identical to any sequence described herein (which can correspond with a particular nucleic acid sequence described herein), such particular polypeptide sequence can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence, the parameters can be set such that the percentage of identity is calculated over the full length of the reference sequence and that gaps in homology of up to 5% of the total reference sequence are allowed.

For example, in a specific embodiment the identity between a reference sequence (query sequence, i.e., a sequence as described herein) and a subject sequence, also referred to as a global sequence alignment, can be determined using the FASTDB computer program based on the algorithm of Brutlag et al. (Comp. App. Biosci. 6:237-245 (1990)). In some cases, parameters for a particular embodiment in which identity is narrowly construed, used in a FASTDB amino acid alignment, can include: Scoring Scheme=PAM (Percent Accepted Mutations) 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject sequence, whichever is shorter. According to this embodiment, if the subject sequence is shorter than the query sequence due to N- or C-terminal deletions, not because of internal deletions, a manual correction can be made to the results to take into consideration the fact that the FASTDB program does not account for N- and C-terminal truncations of the subject sequence when calculating global percent identity. For subject sequences truncated at the N- and C-termini, relative to the query sequence, the percent identity can be corrected by calculating the number of residues of the query sequence that are lateral to the N- and C-terminal of the subject sequence, which are not matched/aligned with a corresponding subject residue, as a percent of the total bases of the query sequence. A determination of whether a residue is matched/aligned can be determined by results of the FASTDB sequence alignment. This percentage can be then subtracted from the percent identity, calculated by the FASTDB program using the specified parameters, to arrive at a final percent identity score. This final percent identity score can be used for the purposes of this embodiment. In some cases, only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence are considered for this manual correction. For example, a 90 residue subject sequence can be aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for.

In some cases, an engineered oligonucleotide or salt thereof can comprise at least about: 70%, 75%, 80%, 85%, 90%, 95%, 96%, 97%, 98%, 99% sequence identity to an oligonucleotide of any SEQ ID NO as described herein. In some cases, an engineered oligonucleotide or salt thereof can comprise at least about: 70%, 75%, 80%, 85%, 90%, 95%, 96%, 97%, 98%, 99% sequence identity to at least 10 contiguous bases of an oligonucleotide of any one of SEQ ID NOs as described herein.

TABLE 1

Natural Human miRNAs

| miRNA Oligo | Sequence (5'-3') | SEQ ID NO: |
|---|---|---|
| miR-30a-5p | UGUAAACAUCCUCGACUGGAAG | 1 |
| miR-30b-5p | UGUAAACAUCCUACACUCAGCU | 2 |
| miR-30c-5p | UGUAAACAUCCUACACUCUCAGC | 3 |
| miR-30d-5p | UGUAAACAUCCCCGACUGGAAG | 4 |
| miR-30e-5p | UGUAAACAUCCUUGACUGGAAG | 5 |
| miR-30a-3p | CUUUCAGUCGGAUGUUUGCAGC | 6 |
| miR-30b-3p | CUGGGAGGUGGAUGUUUACUUC | 7 |
| miR-30c-1-3p | CUGGGAGAGGGUUGUUUACUCC | 8 |
| miR-30c-2-3p | CUGGGAGAAGGCUGUUUACUCU | 9 |
| miR-30d-3p | CUUUCAGUCAGAUGUUUGCUGC | 10 |
| miR-30e-3p | CUUUCAGUCGGAUGUUUACAGC | 11 |
| miR-29a-3p | UAGCACCAUCUGAAAUCGGUUA | 12 |

TABLE 1-continued

Natural Human miRNAs

| miRNA Oligo | Sequence (5'-3') | SEQ ID NO: |
|---|---|---|
| miR-29b-3p | UAGCACCAUUUGAAAUCAGUGUU | 13 |
| miR-29c-3p | UAGCACCAUUUGAAAUCGGUUA | 14 |
| miR-29a-5p | ACUGAUUUCUUUUGGUGUUCAG | 15 |
| miR-29b-1-5p | GCUGGUUUCAUAUGGUGGUUUAGA | 16 |
| miR-29b-2-5p | CUGGUUUCACAUGGUGGCUUAG | 17 |
| miR-29c-5p | UGACCGAUUUCUCCUGGUGUUC | 18 |
| miR-26a-5p | UUCAAGUAAUCCAGGAUAGGCU | 19 |
| miR-26b-5p | UUCAAGUAAUUCAGGAUAGGU | 20 |
| miR-26a-1-3p | CCUAUUCUUGGUUACUUGCACG | 21 |
| miR-26a-2-3p | CCUAUUCUUGAUUACUUGUUUC | 22 |
| miR-26b-3p | CCUGUUCUCCAUUACUUGGCUC | 23 |
| miR-27a-5p | AGGGCUUAGCUGCUUGUGAGCA | 24 |
| miR-27b-5p | AGAGCUUAGCUGAUUGGUGAAC | 25 |
| miR-27a-3p | UUCACAGUGGCUAAGUUCCGC | 26 |
| miR-27b-3p | UUCACAGUGGCUAAGUUCUGC | 27 |
| miR-101-3p | UACAGUACUGUGAUAACUGAA | 28 |
| miR-101-5p | CAGUUAUCACAGUGCUGAUGCU | 29 |
| miR-145-5p | GUCCAGUUUUCCCAGGAAUCCCU | 30 |
| miR-145-3p | GGAUUCCUGGAAAUACUGUUCU | 31 |
| miR-205-5p | UCCUUCAUUCCACCGGAGUCUG | 32 |
| miR-205-3p | GAUUUCAGUGGAGUGAAGUUC | 33 |
| miR-338-3p | UCCAGCAUCAGUGAUUUUGUUG | 34 |
| miR-338-5p | AACAAUAUCCUGGUGCUGAGUG | 35 |
| miR-375-3p | UUUGUUCGUUCGGCUCGCGUGA | 36 |
| miR-375-5p | GCGACGAGCCCCUCGCACAAACC | 37 |

TABLE 2 natural miRNA mimic composition

| miRNA Name | Guide Strand | Passenger Strand |
|---|---|---|
| miR-30a | miR-30a-5p (SEQ ID NO. 1) | miR-30a-3p (SEQ ID NO. 6) |
| miR-30b | miR-30b-5p (SEQ ID NO. 2) | miR-30b-3p (SEQ ID NO. 7) |
| miR-30c-1 | miR-30c-5p (SEQ ID NO. 3) | miR-30c-1-3p (SEQ ID NO. 8) |
| miR-30c-2 | miR-30c-5p (SEQ ID NO. 3) | miR-30c-2-3p (SEQ ID NO. 9) |
| miR-30d | miR-30d-5p (SEQ ID NO. 4) | miR-30d-3p (SEQ ID NO. 10) |
| miR-30e | miR-30e-5p (SEQ ID NO. 5) | miR-30e-3p (SEQ ID NO. 11) |
| miR-29a | miR-29a-3p (SEQ ID NO. 12) | miR-29a-5p (SEQ ID NO. 15) |
| miR-29b-1 | miR-29b-3p (SEQ ID NO. 13) | miR-29b-1-5p (SEQ ID NO. 16) |
| miR-29b-2 | miR-29b-3p (SEQ ID NO. 13) | miR-29b-2-5p (SEQ ID NO. 17) |
| miR-29c | miR-29c-3p (SEQ ID NO. 14) | miR-29c-5p (SEQ ID NO. 18) |
| miR-26a-1 | miR-26a-5p (SEQ ID NO. 19) | miR-26a-1-3p (SEQ ID NO. 21) |
| miR-26a-2 | miR-26a-5p (SEQ ID NO. 19) | miR-26a-2-3p (SEQ ID NO. 22) |

TABLE 2-continued natural miRNA mimic composition

| miRNA Name | Guide Strand | Passenger Strand |
|---|---|---|
| miR-26b | miR-26b-5p (SEQ ID NO. 20) | miR-26b-3p (SEQ ID NO. 23) |
| miR-27a | miR-27a-5p (SEQ ID NO.24) | miR-27a-3p (SEQ ID NO. 26) |
| miR-27b | miR-27b-5p (SEQ ID NO. 25) | miR-27b-3p (SEQ ID NO. 27) |
| miR-101 | miR-101-3p (SEQ ID NO. 28) | miR-101-5p (SEQ ID NO. 29) |
| miR-145 | miR-145-5p (SEQ ID NO. 30) | miR-145-3p (SEQ ID NO. 31) |
| miR-205 | miR-205-5p (SEQ ID NO. 32) | miR-205-3p (SEQ ID NO. 33) |
| miR-338 | miR-338-3p (SEQ ID NO. 34) | miR-338-5p (SEQ ID NO. 35) |
| miR-375 | miR-375-3p (SEQ ID NO. 36) | miR-375-5p (SEQ ID NO. 37) |

TABLE 3

Engineered miRNAs

| Oligo | Sequence (5'-3') | SEQ ID NO: |
|---|---|---|
| G006-30 | UGUAAACAUCCUGCGACUGGAA | 38 |
| G007-30 | UGUAAACAUCCUGCGACUGGAAG | 39 |
| G061-30 | UGUAAACAUCCCGCGACUGGAAG | 40 |
| G062-30 | UGUAAACAUCCUGUGACUGGAAG | 41 |
| G063-30 | UGUAAACAUCCCGUGACUGGAAG | 42 |
| G064-30 | UGUAAACAUCCUGACACUCUCAGC | 43 |
| G065-30 | UGUAAACAUCCUGACACUCUCAG | 44 |
| G066-30 | UGUAAACAUCCUGACACUCUCA | 45 |
| G075-30 | UGUAAACAUCCUGACACUCAGCU | 624 |
| G076-30 | UGUAAACAUCCCGUGACAGGAAG | 625 |
| G077-30 | UGUAAACAUCCUGCGACUAGGAA | 626 |
| G078-30 | UGUAAACAUCCUGCGACUGGUAA | 627 |
| G079-30 | UGUAAACAUCCCUGACUGGAAG | 628 |
| G080-30 | UGUAAACAUCCUCGACUCAGCU | 629 |
| G081-30 | UGUAAACAUCCUCGACUCUCAGC | 630 |
| G082-30 | UGUAAACAUCCUUCACUCAGCU | 631 |
| G083-30 | UGUAAACAUCCUUCACUCUCAGC | 632 |
| G084-30 | UGUAAACAUCCCACACUCAGCU | 633 |
| G085-30 | UGUAAACAUCCCACACUCUCAGC | 634 |
| G086-30 | UGUAAACAUCCCUCACUCAGCU | 635 |
| G087-30 | UGUAAACAUCCCUCACUCUCAGC | 636 |
| G088-30 | UGUAAACAUCCUGCGACUCAGCU | 637 |
| G089-30 | UGUAAACAUCCUCGACAGGAAG | 638 |
| G090-30 | UGUAAACAUCCUGCGACAGGAAG | 639 |
| G091-30 | UGUAAACAUCCUCGACAUGGAAG | 640 |
| G092-30 | UGUAAACAUCCUCGAACUGGAAG | 641 |
| G093-30 | UGUAAACAUCCUGCGAACUGGAA | 642 |
| G094-30 | UGUAAACAUCCCUGACAGGAAG | 643 |
| P001-30 | CCAGUCGAGGAUGUUUACA | 46 |
| P002-30 | CCAGUCGCAGGAUGUUUACA | 47 |

TABLE 3-continued

Engineered miRNAs

| Oligo | Sequence (5'-3') | SEQ ID NO: |
|---|---|---|
| P003-30 | UCCAGUCGAGGAUGUUUACA | 48 |
| P004-30 | UCCAGUCGCAGGAUGUUUACA | 49 |
| P005-30 | UCCAGUCGGAUGUUUACA | 50 |
| P125-30 | UUCAGUCGGAUGUUUGCAGC | 51 |
| G008-30 | fUmGfUmAfAmAfCmAfUmCfCmUmGfCmGfAmCfUmGfGmAdAymG | 52 |
| G009-30 | fUmGfUmAfAmAfCmAfUmCfCmUmGfCmGfAmCfUmGfGmAfAymG | 53 |
| G010-30 | fUmGfUmAfAmAfCmAfUmCfCmUmGsfCmGfAmCfUmGfGmAsfAsmG | 54 |
| G011-30 | UGUAAACAUCmCmUmCmGmAmCmUmGGAAG | 55 |
| G012-30 | fUmGfUmAfAmAfCmAfUmCfCmUmGyfCmGfAmCfUmGfGmAsfAsmG | 56 |
| G014-30 | fUmGfUmAfAmAfCmAfUmCfCmUsmGfCmGfAmCfUmGfGmAsfAsmG | 57 |
| G025-30 | fUmGfUmAfAmAfCmAfUmCfCmUsmGsfCmGfAmCfUmGfGmAsfAsmG | 58 |
| G026-30 | fUmGfUmAfAmAfCmAfUmCfCmUymGfCmGfAmCfUmGfGmAsfAsmG | 59 |
| G027-30 | UGUAAACAUCmCmUmGmCmGmAmCmUGGfAymA | 60 |
| G028-30 | UGUAAACAUCmCmUmGmCmGmAmCmUGGsfAsmA | 61 |
| G029-30 | UGUAAACAUCmCmUmGmCmGmAmCmUmGGAfAymG | 62 |
| G030-30 | UGUAAACAUCmCmUmGmCmGmAmCmUmGGfAymA | 63 |
| G031-30 | UGUAAACAUCmCmUmGmCmGmAmCmUmGGsfAsmA | 64 |
| G032-30 | fUmGfUmAfAmAfCmAfUmCfCmUmGfCmGfAmCfUmGfGmAsfAsmG | 65 |
| G033-30 | UGUAAACAUCmCmUmGsmCmGmAmCmUmGGAsfAsmA | 644 |
| G034-30 | UGUAAACAUCmCmUmGymCmGmAmCmUmGGAsfAsmA | 66 |
| G035-30 | mUsmGUAAACAUCmCmUmGmCmGmAmCmUmGGAsfAsmG | 67 |
| G038-30 | UGUAAACAUCmCmUsmGmCmGmAmCmUmGGsfAsmA | 645 |
| G039-30 | fUmGfUAAACAfUmCfCmUfCmGfAmCfUmGfGmAsfAsmG | 68 |
| G042-30 | fUmGfUmAfAmAfCmAfUmCfCmUfCmGfAmCfUmGfGmAsfAsmG | 69 |
| G056-30 | UGUAAACAUCmCmUsmGsmCmGmAmCmUmGGsfAsmA | 70 |
| G057-30 | UGUAAACAUCmCmUymGmCmGmAmCmUmGGsfAsmA | 71 |
| G058-30 | UGUAAACAUfCmCfUmGfCmGfAmCfUGGsfAsmA | 72 |
| G059-30 | UGUAAACAUmCfCmUfGmCfGmAfCmUGGsfAsmA | 73 |
| G060-30 | UGUAAACAUmCmCmUmGmCmGmAmCmUGGsfAsmA | 74 |
| G067-30 | UGUAAACAUCmCmUmsGmCmGmAmCmUmGGsfAsmA | 75 |
| G068-30 | UGUAAACAUCmCmUmGmsCmGmAmCmUmGGAsfAsmA | 76 |
| G069-30 | UGUAAACAUCmCmUmAmCmAmCmUmCAGsfCsmU | 77 |
| G070-30 | UGUAAACAUCmCmCmCmGmAmCmUmGGAsfAsmG | 78 |
| G071-30 | UGUAAACAUCmCmCmGmCmGmAmCmUmGGAsfAsmG | 79 |

TABLE 3-continued

Engineered miRNAs

| Oligo | Sequence (5'-3') | SEQ ID NO: |
|---|---|---|
| G072-30 | mUsmGUAAACAUCmCmUmGmCmGmAmCmUmGGmAsfAsmG | 80 |
| G073-30 | mUsmGUAAACAUmCmCmUmGmCmGmAmCmUGGmAsfAsmG | 81 |
| G074-30 | mUsmGsmUAAACAUCmCmUmGmCmGmAmCmUGGmAsfAsmG | 82 |
| G095-30 | UGUAAACAUCmCmCmUmGmAmCmAmGGApfApmG | 646 |
| G096-30 | UGUAAACAUCmCmCmUmGmAmCmAGGApfApmG | 647 |
| G097-30 | UGUAAACAUCmCmCmUmGmAmCAGGApfApmG | 648 |
| G098-30 | UGUAAACAUmCmCmCmUmGmAmCmAmGGApfApmG | 649 |
| G099-30 | UGUAAACAUmCmCmCmUmGmAmCmAGGApfApmG | 650 |
| G100-30 | UGUAAACAUmCmCmCmUmGmAmCAGGApfApmG | 651 |
| G101-30 | UGUAAACAmUmCmCmCmUmGmAmCmAGGApfApmG | 652 |
| G102-30 | UGUAAACAmUmCmCmCmUmGmAmCAGGApfApmG | 653 |
| G103-30 | UGUAAACAmUmCmCmCmUmGmCAGGApfApmG | 654 |
| G104-30 | UGUAAACAUCmCmUmGmCmGmAmAmCmUGGpfApmA | 655 |
| G105-30 | UGUAAACAUCmCmUmGmCmGmAmAmCUGGpfApmA | 656 |
| G106-30 | UGUAAACAUCmCmUmGmCmGmAmACUGGpfApmA | 657 |
| G107-30 | UGUAAACAUmCmCmUmGmCmGmAmAmCmUGGpfApmA | 658 |
| G108-30 | UGUAAACAUmCmCmUmGmCmGmAmAmCUGGpfApmA | 659 |
| G109-30 | UGUAAACAUmCmCmUmGmCmGmAmACUGGpfApmA | 660 |
| G110-30 | UGUAAACAmUmCmCmUmGmCmGmAmAmCmUGGpfApmA | 661 |
| G111-30 | UGUAAACAmUmCmCmUmGmCmGmAmAmCUGGpfApmA | 662 |
| G112-30 | UGUAAACAmUmCmCmUmGmCmGmAmACUGGpfApmA | 663 |
| G113-30 | UGUAAACAUCmCmUmCmGmAmAmCmUmGGApfApmG | 664 |
| G114-30 | UGUAAACAUCmCmUmCmGmAmAmCmUGGApfApmG | 665 |
| G115-30 | UGUAAACAUCmCmUmCmGmAmAmCUGGApfApmG | 666 |
| G116-30 | UGUAAACAUmCmCmUmCmGmAmAmCmUmGGApfApmG | 667 |
| G117-30 | UGUAAACAUmCmCmUmCmGmAmAmCmUGGApfApmG | 668 |
| G118-30 | UGUAAACAUmCmCmUmCmGmAmAmCUGGApfApmG | 669 |
| G119-30 | UGUAAACAmUmCmCmUmCmGmAmAmCmUmGGApfApmG | 670 |
| G120-30 | UGUAAACAmUmCmCmUmCmGmAmAmCmUGGApfApmG | 671 |
| G121-30 | fUmGfUmAfAmAfCmAfUmCfCmUfCmGfAmCfUmGfGmAdAymG | 83 |
| G122-30 | fUmGfUAAACAfUmCfCmUfCGACUGfGmAsfAsmG | 84 |
| G123-30 | UGUAAACAmUmCmCmUmCmGmAmAmCUGGApfApmG | 672 |
| G124-30 | UGUAAACAUCmCmUmCmGmAmCmAmUmGGApfApmG | 673 |
| G125-30 | UGUAAACAUCmCmUmCmGmAmCmAmUGGApfApmG | 674 |
| G126-30 | UGUAAACAUCmCmUmCmGmAmCmAUGGApfApmG | 675 |
| G127-30 | UGUAAACAUmCmCmUmCmGmAmCmAmUmGGApfApmG | 676 |

TABLE 3-continued

Engineered miRNAs

| Oligo | Sequence (5'-3') | SEQ ID NO: |
|---|---|---|
| G128-30 | OMe-dTmGfUmAfAmAfCmAfUmCfCmUmGfCmGfAmCfUmGfGmAsfAsmG | 85 |
| G129-30 | UGUAAACAUCmCmUmCmGmAmCmUmGGAsfAsmG | 86 |
| G130-30 | UGUAAACAUCmCmUmCmGmAmCmUmGGAAG | 87 |
| G131-30 | UGUAAACAUmCmCmUmCmGmAmCmAmUGGApfApmG | 677 |
| G132-30 | UGUAAACAUCmCmUmCmGmAmCmUmGGAsfAsmG | 88 |
| G133-30 | UGUAAACAUCmCmUmCmGmAmCmUmGGAA | 89 |
| G134-30 | UGUAAACAUCmCmUmCmGmAmCmAUGGApfApmG | 678 |
| G135-30 | UGUAAACAmUmCmCmUmCmGmAmCmAmUmGGApfApmG | 679 |
| G136-30 | UGUAAACAmUmCmCmUmCmGmAmCmAmUGGApfApmG | 680 |
| G137-30 | UGUAAACAmUmCmCmUmCmGmAmCmAUGGApfApmG | 681 |
| G138-30 | UGUAAACAUCmCmUmCmGmAmCmAmGGApfApmG | 682 |
| G139-30 | UGUAAACAUCmCmUmCmGmGmAmCmAGGApfApmG | 683 |
| G140-30 | UGUAAACAUCmCmUmCmGmCmAGGApfApmG | 684 |
| G141-30 | UGUAAACAUmCmCmUmCmGmCmGmAmCmAmGGApfApmG | 685 |
| G142-30 | UGUAAACAUCmCmUmCmGmCmGmAmCmAGGApfApmG | 686 |
| G143-30 | UGUAAACAUCmCmUmCmGmCmGmAmCAGGApfApmG | 687 |
| G144-30 | UGUAAACAmUmCmCmUmCmGmCmGmAmCmAmGGApfApmG | 688 |
| G145-30 | UGUAAACAmUmCmCmUmCmGmCmGmAmCmAGGApfApmG | 689 |
| G146-30 | UGUAAACAmUmCmCmUmCmGmCmGmAmCAGGApfApmG | 690 |
| G147-30 | UGUAAACAUCmCmUmCmGmAmCmAmGGApfApmG | 691 |
| G148-30 | UGUAAACAUCmCmUmCmGmAmCmAGGApfApmG | 692 |
| G149-30 | UGUAAACAUCmCmUmCmGmAmCAGGApfApmG | 693 |
| G150-30 | UGUAAACAUmCmCmUmCmGmAmCmAmGGApfApmG | 694 |
| G151-30 | UGUAAACAUmCmCmUmCmGmAmCmAGGApfApmG | 695 |
| G152-30 | UGUAAACAUmCmCmUmCmGmAmCAGGApfApmG | 696 |
| G153-30 | UGUAAACAmUmCmCmUmCmGmAmCmAmGGApfApmG | 697 |
| G154-30 | UGUAAACAmUmCmCmUmCmGmAmCmAGGApfApmG | 698 |
| G155-30 | UGUAAACAmUmCmCmUmCmGmAmCAGGApfApmG | 699 |
| G156-30 | UGUAAACAUCmCmUmCmGmCmGmAmCmUmCAGpfCpmU | 700 |
| G157-30 | UGUAAACAUCmCmUmCmGmCmGmAmCmUCAGpfCpmU | 701 |
| G158-30 | UGUAAACAUCmCmUmCmGmCmGmAmCUCAGpfCpmU | 702 |
| G159-30 | UGUAAACAUmCmCmUmCmGmCmGmAmCmUmCAGpfCpmU | 703 |
| G160-30 | UGUAAACAUmCmCmUmCmGmCmGmAmCmUCAGpfCpmU | 704 |
| G161-30 | UGUAAACAUmCmCmUmCmGmCmGmAmCUCAGpfCpmU | 705 |
| G162-30 | UGUAAACAmUmCmCmUmCmGmCmGmAmCmUmCAGpfCpmU | 706 |
| G163-30 | UGUAAACAmUmCmCmUmCmGmCmGmAmCmUCAGpfCpmU | 707 |
| G164-30 | UGUAAACAmUmCmCmUmCmGmCmGmAmCUCAGpfCpmU | 708 |

TABLE 3-continued

Engineered miRNAs

| Oligo | Sequence (5'-3') | SEQ ID NO: |
|---|---|---|
| G165-30 | UGUAAACAUCmCmCmUmCmAmCmUmCmUCApfGpmC | 709 |
| G166-30 | UGUAAACAUCmCmCmUmCmAmCmUmCUCApfGpmC | 710 |
| G167-30 | UGUAAACAUCmCmCmUmCmAmCmUCUCApfGpmC | 711 |
| G168-30 | UGUAAACAUmCmCmCmUmCmAmCmUmCUCApfGpmC | 712 |
| G169-30 | UGUAAACAUmCmCmCmUmCmAmCmUCUCApfGpmC | 713 |
| G170-30 | UGUAAACAUmCmCmCmUmCmAmCUCUCApfGpmC | 714 |
| G171-30 | UGUAAACAmUmCmCmCmUmCmAmCmUmCUCApfGpmC | 715 |
| G172-30 | UGUAAACAmUmCmCmCmUmCmAmCmUCUCApfGpmC | 716 |
| G173-30 | UGUAAACAmUmCmCmCmUmCmAmCUCUCApfGpmC | 717 |
| G174-30 | UGUAAACAUCmCmCmUmCmAmCmUmCAGpfCpmU | 718 |
| G175-30 | UGUAAACAUCmCmCmUmCmAmCmUCAGpfCpmU | 719 |
| G176-30 | UGUAAACAUCmCmCmUmCmAmCUCAGpfCpmU | 720 |
| G177-30 | UGUAAACAUmCmCmCmUmCmAmCmUCAGpfCpmU | 721 |
| G178-30 | UGUAAACAUmCmCmCmUmCmAmCmUCAGpfCpmU | 722 |
| G179-30 | UGUAAACAUmCmCmCmUmCmAmCUCAGpfCpmU | 723 |
| G180-30 | UGUAAACAmUmCmCmCmUmCmAmCmUmCAGpfCpmU | 724 |
| G181-30 | UGUAAACAmUmCmCmCmUmCmAmCmUCAGpfCpmU | 725 |
| G182-30 | UGUAAACAmUmCmCmCmUmCmAmCUCAGpfCpmU | 726 |
| G183-30 | UGUAAACAUCmCmCmAmCmAmCmUmCUCApfGpmC | 727 |
| G184-30 | UGUAAACAUCmCmCmAmCmAmCmUmCUCApfGpmC | 728 |
| G185-30 | UGUAAACAUCmCmCmAmCmAmCmUCUCApfGpmC | 729 |
| G186-30 | UGUAAACAUmCmCmCmAmCmAmCmUmCUCApfGpmC | 730 |
| G187-30 | UGUAAACAUmCmCmCmAmCmAmCmUCUCApfGpmC | 731 |
| G188-30 | UGUAAACAUmCmCmCmAmCmAmCUCUCApfGpmC | 732 |
| G189-30 | UGUAAACAmUmCmCmCmAmCmAmCmUmCUCApfGpmC | 733 |
| G190-30 | UGUAAACAmUmCmCmCmAmCmAmCmUCUCApfGpmC | 734 |
| G191-30 | UGUAAACAmUmCmCmCmAmCmAmCUCUCApfGpmC | 735 |
| G192-30 | UGUAAACAUCmCmCmAmCmAmCmUmCAGpfCpmU | 736 |
| G193-30 | UGUAAACAUCmCmCmAmCmAmCmUCAGpfCpmU | 737 |
| G194-30 | UGUAAACAUCmCmCmAmCmAmCUCAGpfCpmU | 738 |
| G195-30 | UGUAAACAUmCmCmCmAmCmAmCmUCAGpfCpmU | 739 |
| G196-30 | UGUAAACAUmCmCmCmAmCmAmCmUCAGpfCpmU | 740 |
| G197-30 | UGUAAACAUmCmCmCmAmCmAmCUCAGpfCpmU | 741 |
| G198-30 | UGUAAACAmUmCmCmCmAmCmAmCmUmCAGpfCpmU | 742 |
| G199-30 | UGUAAACAmUmCmCmCmAmCmAmCmUCAGpfCpmU | 743 |
| G200-30 | UGUAAACAmUmCmCmCmAmCmAmCUCAGpfCpmU | 744 |
| G201-30 | UGUAAACAUCmCmUmCmAmCmUmCmUCApfGpmC | 745 |
| G202-30 | UGUAAACAUCmCmUmCmAmCmUmCUCApfGpmC | 746 |

TABLE 3-continued

Engineered miRNAs

| Oligo | Sequence (5'-3') | SEQ ID NO: |
|---|---|---|
| G203-30 | UGUAAACAUCmCmUmUmCmAmCmUCUCApfGpmC | 747 |
| G204-30 | UGUAAACAUmCmCmUmUmCmAmCmUmCApfGpmC | 748 |
| G205-30 | UGUAAACAUmCmCmUmUmCmAmCmUCApfGpmC | 749 |
| G206-30 | UGUAAACAUmCmCmUmUmCmAmCmUCUCApfGpmC | 750 |
| G207-30 | UGUAAACAmUmCmCmUmUmCmAmCmUmCApfGpmC | 751 |
| G208-30 | UGUAAACAmUmCmCmUmUmCmAmCmUCApfGpmC | 752 |
| G209-30 | UGUAAACAmUmCmCmUmUmCmAmCmUCUCApfGpmC | 753 |
| G210-30 | UGUAAACAUCmCmUmUmCmAmCmUmCAGpfCpmU | 754 |
| G211-30 | UGUAAACAUCmCmUmUmCmAmCmUCAGpfCpmU | 755 |
| G212-30 | UGUAAACAUCmCmUmUmCmAmCUCAGpfCpmU | 756 |
| G213-30 | UGUAAACAUmCmCmUmUmCmAmCmUmCAGpfCpmU | 757 |
| G214-30 | UGUAAACAUmCmCmUmUmCmAmCmUCAGpfCpmU | 758 |
| G215-30 | UGUAAACAUmCmCmUmUmCmAmCUCAGpfCpmU | 759 |
| G216-30 | UGUAAACAmUmCmCmUmUmCmAmCmUmCAGpfCpmU | 760 |
| G217-30 | UGUAAACAmUmCmCmUmUmCmAmCmUCAGpfCpmU | 761 |
| G218-30 | UGUAAACAmUmCmCmUmUmCmAmCUCAGpfCpmU | 762 |
| G219-30 | UGUAAACAUCmCmUmCmGmAmCmUmCmUCApfGpmC | 763 |
| G220-30 | UGUAAACAUCmCmUmCmGmAmCmUmCUCApfGpmC | 764 |
| G221-30 | UGUAAACAUCmCmUmCmGmAmCmUCUCApfGpmC | 765 |
| G222-30 | UGUAAACAUmCmCmUmCmGmAmCmUmCUCApfGpmC | 766 |
| G223-30 | UGUAAACAUmCmCmUmCmGmAmCmUCUCApfGpmC | 767 |
| G224-30 | UGUAAACAUmCmCmUmCmGmAmCmUCUCApfGpmC | 768 |
| G225-30 | UGUAAACAmUmCmCmUmCmGmAmCmUmCUCApfGpmC | 769 |
| G226-30 | UGUAAACAmUmCmCmUmCmGmAmCmUCUCApfGpmC | 770 |
| G227-30 | UGUAAACAmUmCmCmUmCmGmAmCmUCUCApfGpmC | 771 |
| G228-30 | UGUAAACAUCmCmUmCmGmAmCmUmCAGpfCpmU | 772 |
| G229-30 | UGUAAACAUCmCmUmCmGmAmCmUCAGpfCpmU | 773 |
| G230-30 | UGUAAACAUCmCmUmCmGmAmCUCAGpfCpmU | 774 |
| G231-30 | UGUAAACAUmCmCmUmCmGmAmCmUmCAGpfCpmU | 775 |
| G232-30 | UGUAAACAUmCmCmUmCmGmAmCmUCAGpfCpmU | 776 |
| G233-30 | UGUAAACAUmCmCmUmCmGmAmCUCAGpfCpmU | 777 |
| G234-30 | UGUAAACAmUmCmCmUmCmGmAmCmUmCAGpfCpmU | 778 |
| G235-30 | UGUAAACAmUmCmCmUmCmGmAmCmUCAGpfCpmU | 779 |
| G236-30 | UGUAAACAmUmCmCmUmCmGmAmCUCAGpfCpmU | 780 |
| G237-30 | UGUAAACAUCmCmUmGmAmCmUmUGGApfApmG | 781 |
| G238-30 | UGUAAACAUCmCmUmGmAmCmUGGApfApmG | 782 |
| G239-30 | UGUAAACAUCmCmUmGmAmCUGGApfApmG | 783 |
| G240-30 | UGUAAACAUmCmCmUmGmAmCmUmGGApfApmG | 784 |

TABLE 3-continued

Engineered miRNAs

| Oligo | Sequence (5'-3') | SEQ ID NO: |
|---|---|---|
| G241-30 | UGUAAACAUmCmCmCmUmGmAmCmUGGApfApmG | 785 |
| G242-30 | UGUAAACAUmCmCmCmUmGmAmCUGGApfApmG | 786 |
| G243-30 | UGUAAACAmUmCmCmCmUmGmAmCmUGGApfApmG | 787 |
| G244-30 | UGUAAACAmUmCmCmCmUmGmAmCmUGGApfApmG | 788 |
| G245-30 | UGUAAACAmUmCmCmCmUmGmAmCUGGApfApmG | 789 |
| G246-30 | UGUAAACAUCmCmUmGmCmGmAmCmUmGGUpfApmA | 790 |
| G247-30 | UGUAAACAUCmCmUmGmCmGmAmCmUGGUpfApmA | 791 |
| G248-30 | UGUAAACAUCmCmUmGmCmGmAmCUGGUpfApmA | 792 |
| G249-30 | UGUAAACAUmCmCmUmGmCmGmAmCmUmGGUpfApmA | 793 |
| G250-30 | UGUAAACAUmCmCmUmGmCmGmAmCmUGGUpfApmA | 794 |
| G251-30 | UGUAAACAUmCmCmUmGmCmGmAmCUGGUpfApmA | 795 |
| G252-30 | UGUAAACAmUmCmCmUmGmCmGmAmCmUmGGUpfApmA | 796 |
| G253-30 | UGUAAACAmUmCmCmUmGmCmGmAmCmUGGUpfApmA | 797 |
| G254-30 | UGUAAACAmUmCmCmUmGmCmGmAmCUGGUpfApmA | 798 |
| G255-30 | UGUAAACAUCmCmUmGmCmGmAmCmUmAGGpfApmA | 799 |
| G256-30 | UGUAAACAUCmCmUmGmCmGmAmCmUAGGpfApmA | 800 |
| G257-30 | UGUAAACAUCmCmUmGmCmGmAmCUAGGpfApmA | 801 |
| G258-30 | UGUAAACAUmCmCmUmGmCmGmAmCmUmAGGpfApmA | 802 |
| G259-30 | UGUAAACAUmCmCmUmGmCmGmAmCmUAGGpfApmA | 803 |
| G260-30 | UGUAAACAUmCmCmUmGmCmGmAmCUAGGpfApmA | 804 |
| G261-30 | UGUAAACAmUmCmCmUmGmCmGmAmCmUmAGGpfApmA | 805 |
| G262-30 | UGUAAACAmUmCmCmUmGmCmGmAmCmUAGGpfApmA | 806 |
| G263-30 | UGUAAACAmUmCmCmUmGmCmGmAmCUAGGpfApmA | 807 |
| G264-30 | UGUAAACAUCmCmCmGmUmGmAmCmAmGGApfApmG | 808 |
| G265-30 | UGUAAACAUCmCmCmGmUmGmAmCmAGGApfApmG | 809 |
| G266-30 | UGUAAACAUCmCmCmGmUmGmAmCAGGApfApmG | 810 |
| G267-30 | UGUAAACAUmCmCmCmGmUmGmAmCmAmGGApfApmG | 811 |
| G268-30 | UGUAAACAUmCmCmCmGmUmGmAmCmAGGApfApmG | 812 |
| G269-30 | UGUAAACAUmCmCmCmGmUmGmAmCAGGApfApmG | 813 |
| G270-30 | UGUAAACAmUmCmCmCmGmUmGmAmCmAmGGApfApmG | 814 |
| G271-30 | UGUAAACAmUmCmCmCmGmUmGmAmCmAGGApfApmG | 815 |
| G272-30 | UGUAAACAmUmCmCmCmGmUmGmAmCAGGApfApmG | 816 |
| G273-30 | UGUAAACAUCmCmUmGmAmCmAmCmUmCAGpfCpmU | 817 |
| G274-30 | UGUAAACAUCmCmUmGmAmCmAmCmUCAGpfCpmU | 818 |
| G275-30 | UGUAAACAUCmCmUmGmAmCmAmCUCAGpfCpmU | 819 |
| G276-30 | UGUAAACAUmCmCmUmGmAmCmAmCmUmCAGpfCpmU | 820 |
| G277-30 | UGUAAACAUmCmCmUmGmAmCmAmCmUCAGpfCpmU | 821 |
| G278-30 | UGUAAACAUmCmCmUmGmAmCmAmCUCAGpfCpmU | 822 |

TABLE 3-continued

Engineered miRNAs

| Oligo | Sequence (5'-3') | SEQ ID NO: |
|---|---|---|
| G279-30 | UGUAAACAmUmCmCmUmGmAmCmAmCmUmCAGpfCpmU | 823 |
| G280-30 | UGUAAACAmUmCmCmUmGmAmCmAmCmUCAGpfCpmU | 824 |
| G281-30 | UGUAAACAmUmCmCmUmGmAmCmAmCUCAGpfCpmU | 825 |
| P008-30 | Amino C6-mCmUmGGGAGGUGGAUGUUUACmUmUmC | 90 |
| P009-30 | Amino C6-mCmUmUUCAGUCAGAUGUUUGCmUmGmC | 91 |
| P010-30 | Amino C6-mUsmCsmCAGUCmGmAGGAUGUUUmAsmCsmA | 92 |
| P011-30 | Amino C6-mUsmCsmCAGUmCmGmAmGGAUGUUUmAsmCsmA | 93 |
| P013-30 | Amino C6-mUsmCsmCAGUmCmGmAmGmAmUmGmUmUmUmAsmCsmA | 94 |
| P014-30 | Amino C6-mUmCmCAGUCGGAUGUUUmAmCmA | 95 |
| P015-30 | Amino C6-mUsmCsmCAGUmCfGmAmGGAUGUUUmAsmCsmA | 900 |
| P123-30 | Amino C6-mUmCmCAGUCGAGGAUGUUUmAmCmA | 96 |
| P126-30 | Amino C6-mUmCmCAGUCGCAGGAUGUUUmAmCmA | 97 |
| P128-30 | Amino C6-mCmCmAGUCGAGGAUGUUUmAmCmA | 98 |
| P131-30 | Amino C6-mCmCmAGUCGCAGGAUGUUUmAmCmA | 99 |
| G001-29 | UAGCACCAUCUGAAAGCAGUGUU | 100 |
| G002-29 | UAGCACCAUCUGAAAUCAGUGU | 101 |
| G003-29 | UAGCACCAUCUGAAAUCAGUGUU | 102 |
| G004-29 | UAGCACCAUUUGAAGUCAGUGUU | 103 |
| G005-29 | UAGCACCAUUUGAAGGUCAGUGU | 104 |
| G006-29 | UAGCACCAUCUGAAGUCAGUGUU | 105 |
| G007-29 | UAGCACCAUCUGAAGGUCAGUGU | 106 |
| G008-29 | UAGCACCAUCUGAAGGCAGUGU | 107 |
| G013-29 | UAGCACCAUUUGAAAUCAGUGU | 108 |
| G019-29 | UAGCACCAUCUGAAGGCAGUGUU | 109 |
| G020-29 | UAGCACCAUCUGAAGGUCAGUGUU | 110 |
| G021-29 | UAGCACCAUUUGAAAGCAGUGU | 111 |
| G022-29 | UAGCACCAUUUGAAAGCAGUGUU | 112 |
| G023-29 | UAGCACCAUUUGAAAGUCAGU | 113 |
| G024-29 | UAGCACCAUUUGAAAGUCAGUGU | 114 |
| G025-29 | UAGCACCAUUUGAAGGCAGUGU | 115 |
| G026-29 | UAGCACCAUUUGAAGGUCAGUG | 116 |
| G027-29 | UAGCACCAUUUGAAGGUCAGUGUU | 117 |
| G028-29 | UAGCACCAUUUGAAGUCAGUGU | 118 |
| G029-29 | UAGCACCAUUUGAAAGUCAGUGUU | 119 |
| G030-29 | UAGCACCAUUUGAAAGUCAGUG | 120 |
| G031-29 | UAGCACCAUUUGAAGGCAGUGUU | 121 |
| G032-29 | UAGCACCAUCUGAAGGUCAGUG | 122 |

TABLE 3-continued

Engineered miRNAs

| Oligo | Sequence (5'-3') | SEQ ID NO: |
|---|---|---|
| G033-29 | UAGCACCAUCUGAAGGUCAGU | 123 |
| G034-29 | UAGCACCAUCUGAAGUCAGUGU | 124 |
| G035-29 | UAGCACCAUCUGAAAGCAGUGU | 125 |
| G036-29 | UAGCACCAUCUGAAAGCAGUG | 126 |
| P001-29 | ACUGAUUUCUUUUGGUGUUAG | 155 |
| P002-29 | ACCGAUUUCUUUUGGUGUUA | 156 |
| P003-29 | ACCGAUUUCAGAUGGUGUUA | 157 |
| P010-29 | CGCUGGUUUCAUAUGGUGUUAGA | 158 |
| P015-29 | GCUGGUUUCAUAUGGUGGUUUA | 159 |
| P016-29 | GCUGGUUUCAGAUGGUGGUUUA | 160 |
| P017-29 | GCUGGUUUCAGAUGGUGUUA | 161 |
| P018-29 | ACUGAUUUCAGAUGGUGUUA | 162 |
| P019-29 | CACUGAUUUCAGAUGGUGUUA | 163 |
| P020-29 | CACUGACUUCAGAUGGUGUUA | 164 |
| P021-29 | ACUGACUUUCAGAUGGUGUUA | 165 |
| P022-29 | ACUGACCUUCAGAUGGUGUUA | 166 |
| P023-29 | CUGACUUUCAGAUGGUGUUA | 167 |
| P024-29 | ACUGCUUUCAGAUGGUGUUA | 168 |
| P025-29 | ACUGACUUCAGAUGGUGUUA | 169 |
| G009-29 | mUfAmGfCmAfCmCfAmUfUmUfGmAfAmAfUmCfAmGfUmGyfUymU | 127 |
| G010-29 | mUfAmGfCmAfCmCfAmUfCmUfGmAfAmAfUmCfAmGfUmGyfUymU | 128 |
| G011-29 | mUfAmGfCmAfCmCfAmUfCmUfGmAfAmAfUmCfAmGfUmGyfUymU | 129 |
| G012-29 | mUfAmGfCmAfCmCfAmUfCmUfGmAfAmGfGmCfAmGfUymGyfU | 130 |
| G014-29 | mUfAmGfCmAfCmCfAmUfCmUfGmAfAmGfGmCfAmGfUymGyfU | 131 |
| G015-29 | UAGCACCAUUmUmGmAmAmAmUmCmAmGUGyfUymU | 620 |
| G016-29 | UAGCACCAUCmUmGmAmAmAmUmCmAmGUGyfUymU | 835 |
| G017-29 | UAGCACCAUCmUmGmAmAmAmGmGmUmCmAGUyfGymU | 836 |
| G018-29 | UAGCACCAUCmUmGmAmAmAmGmGmCmAmGUGyfGymU | 837 |
| G037-29 | mUfAmGfCmAfCmCfAmUfUmUfGmAfAmAfUmCfAmGfUmGsfUsmU | 132 |
| G038-29 | mUfAmGfCmAfCmCfAmUfCmUfGmAfAmAfUmCfAmGfUmGsfUsmU | 133 |
| G039-29 | mUfAmGfCmAfCmCfAmUfCmUfGmAfAmAfUmCfAmGfUmGsfUsmU | 134 |
| G040-29 | mUfAmGfCmAfCmCfAmUfCmUfGmAfAmGfGmCfAmGfUsmGsfU | 135 |
| G041-29 | mUfAmGfCmAfCmCfAmUfCmUfGmAfAmGfGmCfAmGfUsmGsfU | 136 |
| G042-29 | UAGCACCAUmUmUmGmAmAmGmGmUmCAGUGU | 137 |
| G043-29 | UAGCACCAUmUmUmGmAmAmGmGmUmCAGUsfGsmU | 138 |

TABLE 3-continued

Engineered miRNAs

| Oligo | Sequence (5'-3') | SEQ ID NO: |
|---|---|---|
| G044-29 | UAGCACCAUmUmUmGmAmAmGmGmUCAGUG | 139 |
| G045-29 | UAGCACCAUmUmUmGmAmAmGmGmUCAGsfUsmG | 140 |
| G046-29 | UAGCACCAUmCmUmGmAmAmGmGmUmCAGUsfGsmU | 141 |
| G047-29 | UAGCACCAUmCmUmGmAmAmGmGmUCAGsfUsmG | 142 |
| G048-29 | UAGCACCAUmUmUmGmAmAmAmUmCAGUGUU | 143 |
| G049-29 | UAGCACCAUmUmUmGmAmAmAmUmCAGUGsfUsmU | 144 |
| G050-29 | UAGCACCAUmCmUmGmAmAmAmUmCAGUGUU | 145 |
| G051-29 | UAGCACCAUmCmUmGmAmAmAmUmCAGUGsfUsmU | 146 |
| G052-29 | UAGCACCAUmCmUmGmAmAmGmUmCAGUGUU | 147 |
| G053-29 | UAGCACCAUmCmUmGmAmAmGmUmCAGUGsfUsmU | 148 |
| G054-29 | UAGCACCAUmUfUmGfAmAfAmUfCAGUGsfUsmU | 149 |
| G055-29 | UAGCACCAUmCfUmGfAmAfAmUfCAGUGsfUsmU | 150 |
| G056-29 | UAGCACCAUmCfUmGfAmAfGmUfCAGUGsfUsmU | 151 |
| G057-29 | UAGCACCAUmCfUmGfAmAfGmGfCAGUsfGsmU | 152 |
| G058-29 | mUfAmGfCmAfCmCfAmUfUmUfGmAfAmAfUmCfAmGfUsmGsfU | 153 |
| G059-29 | mUfAmGfCmAfCmCfAmUfCmUfGmAfAmAfUmCfAmGfUsmGsfU | 154 |
| P004-29 | Amino C6-mGmCmUGGUUUCAUAUGGUGGmUmUmUmA | 170 |
| P005-29 | Amino C6-mGmCmUGGUUUCAGAUGGUGGmUmUmUmA | 171 |
| P006-29 | Amino C6-mGmCmUGGUUUCAGAUGGUGmUmUmA | 172 |
| P007-29 | Amino C6-mAmCmUGAUUUCAGAUGGUGmUmUmA | 173 |
| P008-29 | Amino C6-mAmCmCGAUUUCUUUUGGUGmUmUmA | 174 |
| P009-29 | Amino C6-mAmCmCGAUUUCAGAUGGUGmUmUmA | 175 |
| P011-29 | Amino C6-mCmAmCUGAUUUCAGAUGGUGmUmUmA | 176 |
| P012-29 | Amino C6-mCmAmCUmGAUUUCAGAUmGGmUGmUmUmA | 838 |
| P013-29 | Amino C6-mAmCmUGACUUUCAGAUGGUGmUmUmA | 177 |
| P014-29 | Amino C6-mCmAmCUmGmCUUUCAGAUGGUGmUmUmA | 839 |
| P026-29 | Amino C6-mCmAmCUGAUUUCAGAUGGUGmUmUA | 178 |
| P027-29 | Amino C6-mCmAmCUGACUUUCAGAUGGUGmUmUmA | 179 |
| P028-29 | Amino C6-mAmCmUGACCUUCAGAUGGUGmUmUmA | 180 |
| P029-29 | Amino C6-mCmUmGACUUUCAGAUGGUGmUmUmA | 181 |
| P030-29 | Amino C6-mAmCmUGCUUUCAGAUGGUGmUmUmA | 182 |
| P031-29 | Amino C6-mAmCmUGACUUUCAGAUGGUGmUmUmA | 183 |
| G001-26 | UUCAAGUAAUmCmCmAmGmGmAmUmAGGsfCsmU | 184 |
| G002-26 | UUCAAGUAAUmUmCmAmGmGmAmUAGsfGsmU | 185 |
| G003-26 | UUCAAGUAAUmCmCmAmGmGmAmUAGGsfCsmU | 186 |
| G004-26 | UUCAAGUAAUmCmCmAmGmGmAUAGGsfCsmU | 187 |
| G005-26 | UUCAAGUAAmUmCmCmAmGmGmAmUmAGGsfCsmU | 188 |
| G006-26 | UUCAAGUAAmUmCmCmAmGmGmAmUAGGsfCsmU | 189 |

TABLE 3-continued

Engineered miRNAs

| Oligo | Sequence (5'-3') | SEQ ID NO: |
|---|---|---|
| G007-26 | UUCAAGUAAmUmCmCmAmGmGmAUAGGsfCsmU | 190 |
| G008-26 | UUCAAGUAmAmUmCmCmAmGmGmAmUmAGGsfCsmU | 191 |
| G009-26 | UUCAAGUAmAmUmCmCmAmGmGmAmUAGGsfCsmU | 192 |
| G010-26 | UUCAAGUAmAmUmCmCmAmGmGmAUAGGsfCsmU | 193 |
| G011-26 | UUCAAGUAAUmUmCmAmGmGmAUAGsfGsmU | 194 |
| G012-26 | UUCAAGUAAUmUmCmAmGmGAUAGsfGsmU | 195 |
| G013-26 | UUCAAGUAAmUmUmCmAmGmGmAmUAGsfGsmU | 196 |
| G014-26 | UUCAAGUAAmUmUmCmAmGmGmAUAGsfGsmU | 197 |
| G015-26 | UUCAAGUAAmUmUmCmAmGmGAUAGsfGsmU | 198 |
| G016-26 | UUCAAGUAmAmUmUmCmAmGmGmAmUAGsfGsmU | 199 |
| G017-26 | UUCAAGUAmAmUmUmCmAmGmGmAUAGsfGsmU | 200 |
| G018-26 | UUCAAGUAmAmUmUmCmAmGmGAUAGsfGsmU | 201 |
| P001-26 | Amino C6-mCmCmUAUUCUUGGUUACUUGCmAmCmG | 202 |
| P002-26 | Amino C6-mCmCmUAUUCUUGAUUACUUGUmUmUmC | 203 |
| P003-26 | Amino C6-mCmCmUGUUCUCCAUUACUUGGmCmUmC | 204 |
| G002-27 | AGGGCUUAGCmUmGmCmUmUmGmUmGAGsfCsmA | 205 |
| G003-27 | AGGGCUUAGCmUmGmCmUmUmGmUGAGsfCsmA | 206 |
| G004-27 | AGGGCUUAGCmUmGmCmUmUmGUGAGsfCsmA | 207 |
| G005-27 | AGGGCUUAGmCmUmGmCmUmUmGmUmGAGsfCsmA | 208 |
| G006-27 | AGGGCUUAGmCmUmGmCmUmUmGmUGAGsfCsmA | 209 |
| G007-27 | AGGGCUUAGmCmUmGmCmUmUmGUGAGsfCsmA | 210 |
| G008-27 | AGGGCUUAmGmCmUmGmCmUmUmGmUmGAGsfCsmA | 211 |
| G009-27 | AGGGCUUAmGmCmUmGmCmUmUmGmUGAGsfCsmA | 212 |
| G010-27 | AGGGCUUAmGmCmUmGmCmUmUmGUGAGsfCsmA | 213 |
| G011-27 | AGAGCUUAGCmUmGmAmUmUmGmGmUGAsfAsmC | 214 |
| G012-27 | AGAGCUUAGCmUmGmAmUmUmGmGUGAsfAsmC | 215 |
| G013-27 | AGAGCUUAGCmUmGmAmUmUmGGUGAsfAsmC | 216 |
| G014-27 | AGAGCUUAGmCmUmGmAmUmUmGmGmUGAsfAsmC | 217 |
| G015-27 | AGAGCUUAGmCmUmGmAmUmUmGmGUGAsfAsmC | 218 |
| G016-27 | AGAGCUUAGmCmUmGmAmUmUmGGUGAsfAsmC | 219 |
| G017-27 | AGAGCUUAmGmCmUmGmAmUmUmGmGmUGAsfAsmC | 220 |
| G018-27 | AGAGCUUAmGmCmUmGmAmUmUmGmGUGAsfAsmC | 221 |
| G019-27 | AGAGCUUAmGmCmUmGmAmUmUmGGUGAsfAsmC | 222 |
| P001-27 | Amino C6-mUmUmCACAGUGGCUAAGUUCmCmCmGmC | 223 |
| P002-27 | Amino C6-mUmUmCACAGUGGCUAAGUUCmUmGmC | 224 |
| G001-101 | UACAGUACUGmUmGmAmUmAmACUGsfAsmA | 225 |
| G002-101 | UACAGUACUGmUmGmAmUmAmACUGsfAsmA | 226 |
| G003-101 | UACAGUACUGmUmGmAmUmAACUGsfAsmA | 227 |

TABLE 3-continued

Engineered miRNAs

| Oligo | Sequence (5'-3') | SEQ ID NO: |
|---|---|---|
| G004-101 | UACAGUACUmGmUmGmAmUmAmACUGsfAsmA | 228 |
| G005-101 | UACAGUACUmGmUmGmAmUmAmACUGsfAsmA | 229 |
| G006-101 | UACAGUACUmGmUmGmAmUmAACUGsfAsmA | 230 |
| G007-101 | UACAGUACmUmGmUmGmAmUmAmCUGsfAsmA | 231 |
| G008-101 | UACAGUACmUmGmUmGmAmUmAmACUGsfAsmA | 232 |
| G009-101 | UACAGUACmUmGmUmGmAmUmAACUGsfAsmA | 233 |
| P001-101 | Amino C6-mCmAmGUUAUCACAGUGCUGAUmGmCmU | 234 |
| G001-145 | GUCCAGUUUUmCmCmCmAmGmAmAmUCCsfCsmU | 235 |
| G002-145 | GUCCAGUUUUmCmCmCmAmGmAmAUCCsfCsmU | 236 |
| G003-145 | GUCCAGUUUUmCmCmCmAmGmAAUCCsfCsmU | 237 |
| G004-145 | GUCCAGUUUmUmCmCmCmAmGmGmAmAmUCCsfCsmU | 238 |
| G005-145 | GUCCAGUUUmUmCmCmCmAmGmGmAmAUCCsfCsmU | 239 |
| G006-145 | GUCCAGUUUmUmCmCmCmAmGmGmAAUCCsfCsmU | 240 |
| G007-145 | GUCCAGUUmUmUmCmCmCmAmGmGmAmAmUCCsfCsmU | 241 |
| G008-145 | GUCCAGUUmUmUmCmCmCmAmGmGmAmAUCCsfCsmU | 242 |
| G009-145 | GUCCAGUUmUmUmCmCmCmAmGmGmAAUCCsfCsmU | 243 |
| P001-145 | Amino C6-mGmGmAUUCCUGGAAAUACUGUmUmCmU | 244 |
| G001-205 | UCCUUCAUACCACCGGAGUGUG | 245 |
| G002-205 | UCCUUCAUACCCACCGGAGUCUG | 246 |
| G003-205 | UCCUUCAUACCUCCGGAGUCUG | 247 |
| G004-205 | UCCUUCAUACCUCCGGAGUGUG | 248 |
| G005-205 | UCCUUCAUAUCCACCGGAGUGCU | 249 |
| G006-205 | UCCUUCAUAUCCACCGGAGUGUG | 250 |
| G007-205 | UCCUUCAUAUCCUCCGGAGUGCU | 251 |
| G008-205 | UCCUUCAUAUCCUCCGGAGUGUG | 252 |
| G009-205 | UCCUUCAUCCCACCGGAGUGUG | 253 |
| G010-205 | UCCUUCAUCCCUCCGGAGUCUG | 254 |
| G011-205 | UCCUUCAUCCCUCCGGAGUGUG | 255 |
| G012-205 | UCCUUCAUCUCCACCGGAGUGCU | 256 |
| G013-205 | UCCUUCAUCUCCACCGGAGUGUG | 257 |
| G014-205 | UCCUUCAUCUCCUCCGGAGUGCU | 258 |
| G015-205 | UCCUUCAUUCCACCGGAGUGCUG | 259 |
| G016-205 | UCCUUCAUUCCACCGGAGUGUG | 260 |
| G017-205 | UCCUUCAUUCCAUCGGAGUGCUG | 261 |
| G018-205 | UCCUUCAUUCCUCCGGAGUCUG | 262 |
| G019-205 | UCCUUCAUUCCUCCGGAGUGUG | 263 |
| G200-205 | UCCUUCAUACCACCGGAGUCUG | 840 |
| G201-205 | UCCUUCAUCCCACCGGAGUCUG | 841 |

TABLE 3-continued

Engineered miRNAs

| Oligo | Sequence (5'-3') | SEQ ID NO: |
|---|---|---|
| G202-205 | UCCUUCAUAUCCACCGGAGUCUG | 842 |
| G203-205 | UCCUUCAUCUCCACCGGAGUCUG | 843 |
| G204-205 | UCCUUCAUCACCACCGGAGUCUG | 844 |
| G205-205 | UCCUUCAUAUCCUCCGGAGUCUG | 845 |
| G020-205 | UCCUUCAUUCmCmAmCmCmGmGmAmGUCsfUsmG | 264 |
| G021-205 | UCCUUCAUUCmCmAmCmCmGmAGUCsfUsmG | 265 |
| G022-205 | UCCUUCAUUCmCmAmCmCmGmGAGUCsfUsmG | 266 |
| G023-205 | UCCUUCAUUmCmCmAmCmCmGmGmAmGUCsfUsmG | 267 |
| G024-205 | UCCUUCAUUmCmCmAmCmCmGmGmAGUCsfUsmG | 268 |
| G025-205 | UCCUUCAUUmCmCmAmCmCmGmGAGUCsfUsmG | 269 |
| G026-205 | UCCUUCAUmUmCmCmAmCmCmGmGmAmGUCsfUsmG | 270 |
| G027-205 | UCCUUCAUmUmCmCmAmCmCmGmGmAGUCsfUsmG | 271 |
| G028-205 | UCCUUCAUmUmCmCmAmCmCmGmGAGUCsfUsmG | 272 |
| G029-205 | UCCUUCAUACmCmAmCmCmGmGmAmGUGsfUsmG | 273 |
| G030-205 | UCCUUCAUACmCmAmCmCmGmGmAGUGsfUsmG | 274 |
| G031-205 | UCCUUCAUACmCmAmCmCmGmGAGUGsfUsmG | 275 |
| G032-205 | UCCUUCAUAmCmCmAmCmCmGmGmAmGUGsfUsmG | 276 |
| G033-205 | UCCUUCAUAmCmCmAmCmCmGmGmAGUGsfUsmG | 277 |
| G034-205 | UCCUUCAUAmCmCmAmCmCmGmGAGUGsfUsmG | 278 |
| G035-205 | UCCUUCAUmAmCmCmAmCmCmGmGmAmGUGsfUsmG | 279 |
| G036-205 | UCCUUCAUmAmCmCmAmCmCmGmGmAGUGsfUsmG | 280 |
| G037-205 | UCCUUCAUmAmCmCmAmCmCmGmGAGUGsfUsmG | 281 |
| G038-205 | UCCUUCAUACmCmAmCmCmGmGmAmGUCsfUsmG | 282 |
| G039-205 | UCCUUCAUACmCmAmCmCmGmGmAGUCsfUsmG | 283 |
| G040-205 | UCCUUCAUACmCmAmCmCmGmGAGUCsfUsmG | 284 |
| G041-205 | UCCUUCAUAmCmCmAmCmCmGmGmAmGUCsfUsmG | 285 |
| G042-205 | UCCUUCAUAmCmCmAmCmCmGmGmAGUCsfUsmG | 286 |
| G043-205 | UCCUUCAUAmCmCmAmCmCmGmGAGUCsfUsmG | 287 |
| G044-205 | UCCUUCAUmAmCmCmAmCmCmGmGmAmGUCsfUsmG | 288 |
| G045-205 | UCCUUCAUmAmCmCmAmCmCmGmGmAGUCsfUsmG | 289 |
| G046-205 | UCCUUCAUmAmCmCmAmCmCmGmGAGUCsfUsmG | 290 |
| G047-205 | UCCUUCAUACmCmUmCmCmGmGmAmGUCsfUsmG | 291 |
| G048-205 | UCCUUCAUACmCmUmCmCmGmGmAGUCsfUsmG | 292 |
| G049-205 | UCCUUCAUACmCmUmCmCmGmGAGUCsfUsmG | 293 |
| G050-205 | UCCUUCAUAmCmCmUmCmCmGmGmAmGUCsfUsmG | 294 |
| G051-205 | UCCUUCAUAmCmCmUmCmCmGmGmAGUCsfUsmG | 295 |
| G052-205 | UCCUUCAUAmCmCmUmCmCmGmGAGUCsfUsmG | 296 |
| G053-205 | UCCUUCAUmAmCmCmUmCmCmGmGmAmGUCsfUsmG | 297 |

TABLE 3-continued

Engineered miRNAs

| Oligo | Sequence (5'-3') | SEQ ID NO: |
|---|---|---|
| G054-205 | UCCUUCAUmAmCmCmUmCmCmGmGmAGUCsfUsmG | 298 |
| G055-205 | UCCUUCAUmAmCmCmUmCmCmGmGAGUCsfUsmG | 299 |
| G056-205 | UCCUUCAUACmCmUmCmCmGmGmAmGUGsfUsmG | 300 |
| G057-205 | UCCUUCAUACmCmUmCmCmGmGmAGUGsfUsmG | 301 |
| G058-205 | UCCUUCAUACmCmUmCmCmGmGAGUGsfUsmG | 302 |
| G059-205 | UCCUUCAUAmCmCmUmCmCmGmGmAmGUGsfUsmG | 303 |
| G060-205 | UCCUUCAUAmCmCmUmCmCmGmGmAGUGsfUsmG | 304 |
| G061-205 | UCCUUCAUAmCmCmUmCmCmGmGAGUGsfUsmG | 305 |
| G062-205 | UCCUUCAUmAmCmCmUmCmCmGmGmAmGUGsfUsmG | 306 |
| G063-205 | UCCUUCAUmAmCmCmUmCmCmGmGmAGUGsfUsmG | 307 |
| G064-205 | UCCUUCAUmAmCmCmUmCmCmGmGAGUGsfUsmG | 308 |
| G065-205 | UCCUUCAUAUmCmCmAmCmCmGmGmAmGUGsfCsmU | 309 |
| G066-205 | UCCUUCAUAUmCmCmAmCmCmGmGmAGUGsfCsmU | 310 |
| G067-205 | UCCUUCAUAUmCmCmAmCmCmGmGAGUGsfCsmU | 311 |
| G068-205 | UCCUUCAUAmUmCmCmAmCmCmGmGmAmGUGsfCsmU | 312 |
| G069-205 | UCCUUCAUAmUmCmCmAmCmCmGmGmAGUGsfCsmU | 313 |
| G070-205 | UCCUUCAUAmUmCmCmAmCmCmGmGAGUGsfCsmU | 314 |
| G071-205 | UCCUUCAUmAmUmCmCmAmCmCmGmGmAmGUGsfCsmU | 315 |
| G072-205 | UCCUUCAUmAmUmCmCmAmCmCmGmGmAGUGsfCsmU | 316 |
| G073-205 | UCCUUCAUmAmUmCmCmAmCmCmGmGAGUGsfCsmU | 317 |
| G074-205 | UCCUUCAUAUmCmCmAmCmCmGmGmAmGUGsfUsmG | 318 |
| G075-205 | UCCUUCAUAUmCmCmAmCmCmGmGmAGUGsfUsmG | 319 |
| G076-205 | UCCUUCAUAUmCmCmAmCmCmGmGAGUGsfUsmG | 320 |
| G077-205 | UCCUUCAUAmUmCmCmAmCmCmGmGmAmGUGsfUsmG | 321 |
| G078-205 | UCCUUCAUAmUmCmCmAmCmCmGmGmAGUGsfUsmG | 322 |
| G079-205 | UCCUUCAUAmUmCmCmAmCmCmGmGAGUGsfUsmG | 323 |
| G080-205 | UCCUUCAUmAmUmCmCmAmCmCmGmGmAmGUGsfUsmG | 324 |
| G081-205 | UCCUUCAUmAmUmCmCmAmCmCmGmGmAGUGsfUsmG | 325 |
| G082-205 | UCCUUCAUmAmUmCmCmAmCmCmGmGAGUGsfUsmG | 326 |
| G083-205 | UCCUUCAUAUmCmCmUmCmCmGmGmAmGUGsfCsmU | 327 |
| G084-205 | UCCUUCAUAUmCmCmUmCmCmGmGmAGUGsfCsmU | 328 |
| G085-205 | UCCUUCAUAUmCmCmUmCmCmGmGAGUGsfCsmU | 329 |
| G086-205 | UCCUUCAUAmUmCmCmUmCmCmGmGmAmGUGsfCsmU | 330 |
| G087-205 | UCCUUCAUAmUmCmCmUmCmCmGmGmAGUGsfCsmU | 331 |
| G088-205 | UCCUUCAUAmUmCmCmUmCmCmGmGAGUGsfCsmU | 332 |
| G089-205 | UCCUUCAUmAmUmCmCmUmCmCmGmGmAmGUGsfCsmU | 333 |
| G090-205 | UCCUUCAUmAmUmCmCmUmCmCmGmGmAGUGsfCsmU | 334 |
| G091-205 | UCCUUCAUmAmUmCmCmUmCmCmGmGAGUGsfCsmU | 335 |

TABLE 3-continued

Engineered miRNAs

| Oligo | Sequence (5'-3') | SEQ ID NO: |
|---|---|---|
| G092-205 | UCCUUCAUAUmCmCmUmCmCmGmGmAmGUGsfUsmG | 336 |
| G093-205 | UCCUUCAUAUmCmCmUmCmCmGmGmAGUGsfUsmG | 337 |
| G094-205 | UCCUUCAUAUmCmCmUmCmCmGmGAGUGsfUsmG | 338 |
| G095-205 | UCCUUCAUAmUmCmCmUmCmCmGmGmAmGUGsfUsmG | 339 |
| G096-205 | UCCUUCAUAmUmCmCmUmCmCmGmGmAGUGsfUsmG | 340 |
| G097-205 | UCCUUCAUAmUmCmCmUmCmCmGmGAGUGsfUsmG | 341 |
| G098-205 | UCCUUCAUmAmUmCmCmUmCmCmGmGmAmGUGsfUsmG | 342 |
| G099-205 | UCCUUCAUmAmUmCmCmUmCmCmGmGmAGUGsfUsmG | 343 |
| G100-205 | UCCUUCAUmAmUmCmCmUmCmCmGmGAGUGsfUsmG | 344 |
| G101-205 | UCCUUCAUCCmCmAmCmCmGmGmAmGUGsfUsmG | 345 |
| G102-205 | UCCUUCAUCCmCmAmCmCmGmGmAGUGsfUsmG | 346 |
| G103-205 | UCCUUCAUCCmCmAmCmCmGmGAGUGsfUsmG | 347 |
| G104-205 | UCCUUCAUCmCmCmAmCmCmGmGmAmGUGsfUsmG | 348 |
| G105-205 | UCCUUCAUCmCmCmAmCmCmGmGmAGUGsfUsmG | 349 |
| G106-205 | UCCUUCAUCmCmCmAmCmCmGmGAGUGsfUsmG | 350 |
| G107-205 | UCCUUCAUmCmCmCmAmCmCmGmGmAmGUGsfUsmG | 351 |
| G108-205 | UCCUUCAUmCmCmCmAmCmCmGmGmAGUGsfUsmG | 352 |
| G109-205 | UCCUUCAUmCmCmCmAmCmCmGmGAGUGsfUsmG | 353 |
| G110-205 | UCCUUCAUCCmCmUmCmCmGmGmAmGUCsfUsmG | 354 |
| G111-205 | UCCUUCAUCCmCmUmCmCmGmGmAGUCsfUsmG | 355 |
| G112-205 | UCCUUCAUCCmCmUmCmCmGmGAGUCsfUsmG | 356 |
| G113-205 | UCCUUCAUCmCmCmUmCmCmGmGmAmGUCsfUsmG | 357 |
| G114-205 | UCCUUCAUCmCmCmUmCmCmGmGmAGUCsfUsmG | 358 |
| G115-205 | UCCUUCAUCmCmCmUmCmCmGmGAGUCsfUsmG | 359 |
| G116-205 | UCCUUCAUmCmCmCmUmCmCmGmGmAmGUCsfUsmG | 360 |
| G117-205 | UCCUUCAUmCmCmCmUmCmCmGmGmAGUCsfUsmG | 361 |
| G118-205 | UCCUUCAUmCmCmCmUmCmCmGmGAGUCsfUsmG | 362 |
| G119-205 | UCCUUCAUCCmCmUmCmCmGmGmAmGUGsfUsmG | 363 |
| G120-205 | UCCUUCAUCCmCmUmCmCmGmGmAGUGsfUsmG | 364 |
| G121-205 | UCCUUCAUCCmCmUmCmCmGmGAGUGsfUsmG | 365 |
| G122-205 | UCCUUCAUCmCmCmUmCmCmGmGmAmGUGsfUsmG | 366 |
| G123-205 | UCCUUCAUCmCmCmUmCmCmGmGmAGUGsfUsmG | 367 |
| G124-205 | UCCUUCAUCmCmCmUmCmCmGmGAGUGsfUsmG | 368 |
| G125-205 | UCCUUCAUmCmCmCmUmCmCmGmGmAmGUGsfUsmG | 369 |
| G126-205 | UCCUUCAUmCmCmCmUmCmCmGmGmAGUGsfUsmG | 370 |
| G127-205 | UCCUUCAUmCmCmCmUmCmCmGmGAGUGsfUsmG | 371 |
| G128-205 | UCCUUCAUCUmCmCmAmCmCmGmGmAmGUGsfCsmU | 372 |
| G129-205 | UCCUUCAUCUmCmCmAmCmCmGmGmAGUGsfCsmU | 373 |

TABLE 3-continued

Engineered miRNAs

| Oligo | Sequence (5'-3') | SEQ ID NO: |
|---|---|---|
| G130-205 | UCCUUCAUCUmCmCmAmCmCmGmGAGUGsfCsmU | 374 |
| G131-205 | UCCUUCAUCmUmCmCmAmCmCmGmGmAmGUGsfCsmU | 375 |
| G132-205 | UCCUUCAUCmUmCmCmAmCmCmGmGmAGUGsfCsmU | 376 |
| G133-205 | UCCUUCAUCmUmCmCmAmCmCmGmGAGUGsfCsmU | 377 |
| G134-205 | UCCUUCAUmCmUmCmCmAmCmCmGmGmAmGUGsfCsmU | 378 |
| G135-205 | UCCUUCAUmCmUmCmCmAmCmCmGmGmAGUGsfCsmU | 379 |
| G136-205 | UCCUUCAUmCmUmCmCmAmCmCmGmGAGUGsfCsmU | 380 |
| G137-205 | UCCUUCAUCUmCmCmAmCmCmGmGmAmGUGsfUsmG | 381 |
| G138-205 | UCCUUCAUCUmCmCmAmCmCmGmGmAGUGsfUsmG | 382 |
| G139-205 | UCCUUCAUCUmCmCmAmCmCmGmGAGUGsfUsmG | 383 |
| G140-205 | UCCUUCAUCmUmCmCmAmCmCmGmGmAmGUGsfUsmG | 384 |
| G141-205 | UCCUUCAUCmUmCmCmAmCmCmGmGmAGUGsfUsmG | 385 |
| G142-205 | UCCUUCAUCmUmCmCmAmCmCmGmGAGUGsfUsmG | 386 |
| G143-205 | UCCUUCAUmCmUmCmCmAmCmCmGmGmAmGUGsfUsmG | 387 |
| G144-205 | UCCUUCAUmCmUmCmCmAmCmCmGmGAGUGsfUsmG | 388 |
| G145-205 | UCCUUCAUmCmUmCmCmAmCmCmGmGAGUGsfUsmG | 389 |
| G146-205 | UCCUUCAUCUmCmCmUmCmCmGmGmAmGUGsfCsmU | 390 |
| G147-205 | UCCUUCAUCUmCmCmUmCmCmGmGAGUGsfCsmU | 391 |
| G148-205 | UCCUUCAUCUmCmCmUmCmCmGmGAGUGsfCsmU | 392 |
| G149-205 | UCCUUCAUCmUmCmCmUmCmCmGmGmAmGUGsfCsmU | 393 |
| G150-205 | UCCUUCAUCmUmCmCmUmCmCmGmGAGUGsfCsmU | 394 |
| G151-205 | UCCUUCAUCmUmCmCmUmCmCmGmGAGUGsfCsmU | 395 |
| G152-205 | UCCUUCAUmCmUmCmCmUmCmCmGmGmAmGUGsfCsmU | 396 |
| G153-205 | UCCUUCAUmCmUmCmCmUmCmCmGmGAGUGsfCsmU | 397 |
| G154-205 | UCCUUCAUmCmUmCmCmUmCmCmGmGAGUGsfCsmU | 398 |
| G155-205 | UCCUUCAUUCmCmAmCmCmGmGmAmGmUGCsfUsmG | 399 |
| G156-205 | UCCUUCAUUCmCmAmCmCmGmGmAmGUGCsfUsmG | 400 |
| G157-205 | UCCUUCAUUCmCmAmCmCmGmGmAGUGCsfUsmG | 401 |
| G158-205 | UCCUUCAUUmCmCmAmCmCmGmGmAmGmUGCsfUsmG | 402 |
| G159-205 | UCCUUCAUUmCmCmAmCmCmGmGmAmGUGCsfUsmG | 403 |
| G160-205 | UCCUUCAUUmCmCmAmCmCmGmGmAGUGCsfUsmG | 404 |
| G161-205 | UCCUUCAUmUmCmCmAmCmCmGmGmAmGmUGCsfUsmG | 405 |
| G162-205 | UCCUUCAUmUmCmCmAmCmCmGmGmAmGUGCsfUsmG | 406 |
| G163-205 | UCCUUCAUmUmCmCmAmCmCmGmGmAGUGCsfUsmG | 407 |
| G164-205 | UCCUUCAUUCmCmAmCmCmGmGmAmGUGsfUsmG | 408 |
| G165-205 | UCCUUCAUUCmCmAmCmCmGmGmAGUGsfUsmG | 409 |
| G166-205 | UCCUUCAUUCmCmAmCmCmGmGAGUGsfUsmG | 410 |
| G167-205 | UCCUUCAUUmCmCmAmCmCmGmGmAmGUGsfUsmG | 411 |

TABLE 3-continued

Engineered miRNAs

| Oligo | Sequence (5'-3') | SEQ ID NO: |
|---|---|---|
| G168-205 | UCCUUCAUUmCmCmAmCmCmGmGmAGUGsfUsmG | 412 |
| G169-205 | UCCUUCAUUmCmCmAmCmCmGmGAGUGsfUsmG | 413 |
| G170-205 | UCCUUCAUmUmCmCmAmCmCmGmGmAmGUGsfUsmG | 414 |
| G171-205 | UCCUUCAUmUmCmCmAmCmCmGmGmAGUGsfUsmG | 415 |
| G172-205 | UCCUUCAUmUmCmCmAmCmCmGmGAGUGsfUsmG | 416 |
| G173-205 | UCCUUCAUUCmCmAmUmCmGmGmAmGmUGCsfUsmG | 417 |
| G174-205 | UCCUUCAUUCmCmAmUmCmGmGmAmGUGCsfUsmG | 418 |
| G175-205 | UCCUUCAUUCmCmAmUmCmGmGmAGUGCsfUsmG | 419 |
| G176-205 | UCCUUCAUUCmCmAmUmCmGmGmAmGmUGCsfUsmG | 420 |
| G177-205 | UCCUUCAUUCmCmAmUmCmGmGmAmGUGCsfUsmG | 421 |
| G178-205 | UCCUUCAUUCmCmAmUmCmGmGmAGUGCsfUsmG | 422 |
| G179-205 | UCCUUCAUmUmCmCmAmUmCmGmGmAmGmUGCsfUsmG | 423 |
| G180-205 | UCCUUCAUmUmCmCmAmUmCmGmGmAmGUGCsfUsmG | 424 |
| G181-205 | UCCUUCAUmUmCmCmAmUmCmGmGmAGUGCsfUsmG | 425 |
| G182-205 | UCCUUCAUUCmCmUmCmCmGmGmAmGUCsfUsmG | 426 |
| G183-205 | UCCUUCAUUCmCmUmCmCmGmGmAGUCsfUsmG | 427 |
| G184-205 | UCCUUCAUUCmCmUmCmCmGmGAGUCsfUsmG | 428 |
| G185-205 | UCCUUCAUUCmCmUmCmCmGmGmAmGUCsfUsmG | 429 |
| G186-205 | UCCUUCAUUCmCmUmCmCmGmGmAGUCsfUsmG | 430 |
| G187-205 | UCCUUCAUUCmCmUmCmCmGmGAGUCsfUsmG | 431 |
| G188-205 | UCCUUCAUmUmCmCmUmCmCmGmGmAmGUCsfUsmG | 432 |
| G189-205 | UCCUUCAUmUmCmCmUmCmCmGmGmAGUCsfUsmG | 433 |
| G190-205 | UCCUUCAUmUmCmCmUmCmCmGmGAGUCsfUsmG | 434 |
| G191-205 | UCCUUCAUUCmCmUmCmCmGmGmAmGUGsfUsmG | 435 |
| G192-205 | UCCUUCAUUCmCmUmCmCmGmGmAGUGsfUsmG | 436 |
| G193-205 | UCCUUCAUUCmCmUmCmCmGmGAGUGsfUsmG | 437 |
| G194-205 | UCCUUCAUUmCmCmUmCmCmGmGmAmGUGsfUsmG | 438 |
| G195-205 | UCCUUCAUUmCmCmUmCmCmGmGmAGUGsfUsmG | 439 |
| G196-205 | UCCUUCAUUmCmCmUmCmCmGmGAGUGsfUsmG | 440 |
| G197-205 | UCCUUCAUmUmCmCmUmCmCmGmGmAmGUGsfUsmG | 441 |
| G198-205 | UCCUUCAUmUmCmCmUmCmCmGmGmAGUGsfUsmG | 442 |
| G199-205 | UCCUUCAUmUmCmCmUmCmCmGmGAGUGsfUsmG | 443 |
| G206-205 | UCCUUCAUACmCmAmCmCmGmGmAmGUCpfUpmG | 846 |
| G207-205 | UCCUUCAUACmCmAmCmCmGmGmAGUCpfUpmG | 847 |
| G208-205 | UCCUUCAUACmCmAmCmCmGmGAGUCpfUpmG | 848 |
| G209-205 | UCCUUCAUAmCmCmAmCmCmGmGmAmGUCpfUpmG | 849 |
| G210-205 | UCCUUCAUAmCmCmAmCmCmGmGmAGUCpfUpmG | 850 |
| G211-205 | UCCUUCAUAmCmCmAmCmCmGmGAGUCpfUpmG | 851 |

TABLE 3-continued

Engineered miRNAs

| Oligo | Sequence (5'-3') | SEQ ID NO: |
|---|---|---|
| G212-205 | UCCUUCAUmAmCmCmAmCmCmGmGmAmGUCpfUpmG | 852 |
| G213-205 | UCCUUCAUmAmCmCmAmCmCmGmGmAGUCpfUpmG | 853 |
| G214-205 | UCCUUCAUmAmCmCmAmCmCmGmGAGUCpfUpmG | 854 |
| G215-205 | UCCUUCAUCCmCmAmCmCmGmGmAmGUCpfUpmG | 855 |
| G216-205 | UCCUUCAUCCmCmAmCmCmGmGmAGUCpfUpmG | 856 |
| G217-205 | UCCUUCAUCCmCmAmCmCmGmGAGUCpfUpmG | 857 |
| G218-205 | UCCUUCAUCmCmAmCmCmGmGmAmGUCpfUpmG | 858 |
| G219-205 | UCCUUCAUCmCmAmCmCmGmGmAGUCpfUpmG | 859 |
| G220-205 | UCCUUCAUCmCmAmCmCmGmGAGUCpfUpmG | 860 |
| G221-205 | UCCUUCAUmCmCmAmCmCmGmGmAmGUCpfUpmG | 861 |
| G222-205 | UCCUUCAUmCmCmAmCmCmGmGmAGUCpfUpmG | 862 |
| G223-205 | UCCUUCAUmCmCmAmCmCmGmGAGUCpfUpmG | 863 |
| G224-205 | UCCUUCAUAUmCmCmAmCmCmGmGmAmGUCpfUpmG | 864 |
| G225-205 | UCCUUCAUAUmCmCmAmCmCmGmGmAGUCpfUpmG | 865 |
| G226-205 | UCCUUCAUAUmCmCmAmCmCmGmGAGUCpfUpmG | 866 |
| G227-205 | UCCUUCAUAmUmCmCmAmCmCmGmGmAmGUCpfUpmG | 867 |
| G228-205 | UCCUUCAUAmUmCmCmAmCmCmGmGmAGUCpfUpmG | 868 |
| G229-205 | UCCUUCAUAmUmCmCmAmCmCmGmGAGUCpfUpmG | 869 |
| G230-205 | UCCUUCAUmAmUmCmCmAmCmCmGmGmAmGUCpfUpmG | 870 |
| G231-205 | UCCUUCAUmAmUmCmCmAmCmCmGmGmAGUCpfUpmG | 871 |
| G232-205 | UCCUUCAUmAmUmCmCmAmCmCmGmGAGUCpfUpmG | 872 |
| G233-205 | UCCUUCAUCUmCmCmAmCmCmGmGmAmGUCpfUpmG | 873 |
| G234-205 | UCCUUCAUCUmCmCmAmCmCmGmGmAGUCpfUpmG | 874 |
| G235-205 | UCCUUCAUCUmCmCmAmCmCmGmGAGUCpfUpmG | 875 |
| G236-205 | UCCUUCAUCmUmCmCmAmCmCmGmGmAmGUCpfUpmG | 876 |
| G237-205 | UCCUUCAUCmUmCmCmAmCmCmGmGmAGUCpfUpmG | 877 |
| G238-205 | UCCUUCAUCmUmCmCmAmCmCmGmGAGUCpfUpmG | 878 |
| G239-205 | UCCUUCAUmCmUmCmCmAmCmCmGmGmAmGUCpfUpmG | 879 |
| G240-205 | UCCUUCAUmCmUmCmCmAmCmCmGmGmAGUCpfUpmG | 880 |
| G241-205 | UCCUUCAUmCmUmCmCmAmCmCmGmGAGUCpfUpmG | 881 |
| G242-205 | UCCUUCAUCAmCmCmAmCmCmGmGmAmGUCpfUpmG | 882 |
| G243-205 | UCCUUCAUCAmCmCmAmCmCmGmGmAGUCpfUpmG | 883 |
| G244-205 | UCCUUCAUCAmCmCmAmCmCmGmGAGUCpfUpmG | 884 |
| G245-205 | UCCUUCAUCmAmCmCmAmCmCmGmGmAmGUCpfUpmG | 885 |
| G246-205 | UCCUUCAUCmAmCmCmAmCmCmGmGmAGUCpfUpmG | 886 |
| G247-205 | UCCUUCAUCmAmCmCmAmCmCmGmGAGUCpfUpmG | 887 |
| G248-205 | UCCUUCAUmCmAmCmCmAmCmCmGmGmAmGUCpfUpmG | 888 |
| G249-205 | UCCUUCAUmCmAmCmCmAmCmCmGmGmAGUCpfUpmG | 889 |

TABLE 3-continued

| Engineered miRNAs | | |
|---|---|---|
| Oligo | Sequence (5'-3') | SEQ ID NO: |
| G250-205 | UCCUUCAUmCmAmCmAmCmCmGmGAGUCpfUpmG | 890 |
| G251-205 | UCCUUCAUAUmCmCmUmCmCmGmGmAmGUCpfUpmG | 891 |
| G252-205 | UCCUUCAUAUmCmCmUmCmCmGmGmAGUCpfUpmG | 892 |
| G253-205 | UCCUUCAUAUmCmCmUmCmCmGmGmGAGUCpfUpmG | 893 |
| G254-205 | UCCUUCAUAmUmCmCmUmCmCmGmGmAmGUCpfUpmG | 894 |
| G255-205 | UCCUUCAUAmUmCmCmUmCmCmGmGmAGUCpfUpmG | 895 |
| G256-205 | UCCUUCAUAmUmCmCmUmCmCmGmGAGUCpfUpmG | 896 |
| G257-205 | UCCUUCAUmAmUmCmCmUmCmCmGmGmAmGUCpfUpmG | 897 |
| G258-205 | UCCUUCAUmAmUmCmCmUmCmCmGmGmAGUCpfUpmG | 898 |
| G259-205 | UCCUUCAUmAmUmCmCmUmCmCmGmGAGUCpfUpmG | 899 |
| P001-205 | Amino C6-mGmAmUUUCAGUGGAGUGAAGmUmUmC | 444 |
| G001-338 | UCCAGCAUCAmGmUmGmAmUmUmUmUGUsfUsmG | 445 |
| G002-338 | UCCAGCAUCAmGmUmGmAmUmUmUUGUsfUsmG | 446 |
| G003-338 | UCCAGCAUCAmGmUmGmAmUmUUUGUsfUsmG | 447 |
| G004-338 | UCCAGCAUCmAmGmUmGmAmUmUmUmUGUsfUsmG | 448 |
| G005-338 | UCCAGCAUCmAmGmUmGmAmUmUmUUGUsfUsmG | 449 |
| G006-338 | UCCAGCAUCmAmGmUmGmAmUmUUUGUsfUsmG | 450 |
| G007-338 | UCCAGCAUmCmAmGmUmGmAmUmUmUmUGUsfUsmG | 451 |
| G008-338 | UCCAGCAUmCmAmGmUmGmAmUmUmUUGUsfUsmG | 452 |
| G009-338 | UCCAGCAUmCmAmGmUmGmAmUmUUUGUsfUsmG | 453 |
| P001-338 | Amino C6-mAmAmCAAUAUCCUGGUGCUGAmGmUmG | 454 |
| G001-375 | UUUGUUCGUUmCmGmGmCmUmCmGmCGUsfGsmA | 455 |
| G002-375 | UUUGUUCGUUmCmGmGmCmUmCmGCGUsfGsmA | 456 |
| G003-375 | UUUGUUCGUUmCmGmGmCmUmCmCGCGUsfGsmA | 457 |
| G004-375 | UUUGUUCGUmUmCmGmGmCmUmCmGmCGUsfGsmA | 458 |
| G005-375 | UUUGUUCGUmUmCmGmGmCmUmCmGCGUsfGsmA | 459 |
| G006-375 | UUUGUUCGUmUmCmGmGmCmUmCmCGCGUsfGsmA | 460 |
| G007-375 | UUUGUUCGmUmUmCmGmGmCmUmCmGmCGUsfGsmA | 461 |
| G008-375 | UUUGUUCGmUmUmCmGmGmCmUmCmGCGUsfGsmA | 462 |
| G009-375 | UUUGUUCGmUmUmCmGmGmCmUmCmCGCGUsfGsmA | 463 |
| P001-375 | Amino C6-mGmCmGACGAGCCCCUCGCACAAmAmCmC | 464 |
| G001-E1 | UUGAGAAGGAGGCUGCUGAGA | 465 |
| P001-E1 | UCAGCAGCCUCCUUCUAA | 466 |

TABLE 4

Mimic/mimetic composition

| Mimic name | Guide Strand | Passenger Strand |
|---|---|---|
| M30-021 | G039-30 (SEQ ID NO. 67) | P014-30 (SEQ ID NO. 95) |
| M30-025 | G032-30 (SEQ ID NO. 65) | P014-30 (SEQ ID NO. 95) |
| M30-033 | G042-30 (SEQ ID NO. 69) | P014-30 (SEQ ID NO. 95) |
| M30-034 | G042-30 (SEQ ID NO. 69) | P123-30 (SEQ ID NO. 96) |
| M30-035 | G121-30 (SEQ ID NO. 83) | P123-30 (SEQ ID NO. 96) |
| M30-036 | G122-30 (SEQ ID NO. 84) | P123-30 (SEQ ID NO. 96) |
| M30-037 | G011-30 (SEQ ID NO. 55) | P123-30 (SEQ ID NO. 96) |
| M30-038 | G121-30 (SEQ ID NO. 83) | P014-30 (SEQ ID NO. 95) |
| M30-039 | G039-30 (SEQ ID NO. 67) | P123-30 (SEQ ID NO. 96) |
| M30-040 | G032-30 (SEQ ID NO. 65) | P123-30 (SEQ ID NO. 96) |
| M30-042 | G128-30 (SEQ ID NO. 85) | P123-30 (SEQ ID NO. 96) |
| M30-043 | G129-30 (SEQ ID NO. 86) | P123-30 (SEQ ID NO. 96) |
| M30-044 | G032-30 (SEQ ID NO. 65) | P126-30 (SEQ ID NO. 97) |
| M30-046 | G130-30 (SEQ ID NO. 87) | P123-30 (SEQ ID NO. 96) |
| M30-047 | G130-30 (SEQ ID NO. 87) | P126-30 (SEQ ID NO. 97) |
| M30-048 | G132-30 (SEQ ID NO. 88) | P123-30 (SEQ ID NO. 96) |
| M30-049 | G133-30 (SEQ ID NO. 89) | P131-30 (SEQ ID NO. 99) |
| M29-002 | miR-29a-3p (SEQ ID NO. 12) | P009-29 (SEQ ID NO. 175) |
| M29-004 | miR-29b-3p (SEQ ID NO. 13) | P004-29 (SEQ ID NO. 170) |
| M29-005 | miR-29b-3p (SEQ ID NO. 13) | P005-29 (SEQ ID NO. 171) |
| M29-006 | miR-29b-3p (SEQ ID NO. 13) | P006-29 (SEQ ID NO. 172) |
| M29-007 | miR-29b-3p (SEQ ID NO. 13) | P007-29 (SEQ ID NO. 173) |
| M29-008 | miR-29b-3p (SEQ ID NO. 13) | P011-29 (SEQ ID NO. 176) |
| M29-009 | G013-29 (SEQ ID NO. 108) | P007-29 (SEQ ID NO. 173) |
| M29-010 | G013-29 (SEQ ID NO. 108) | P006-29 (SEQ ID NO. 172) |
| M29-011 | G003-29 (SEQ ID NO. 102) | P007-29 (SEQ ID NO. 173) |
| M29-012 | G003-29 (SEQ ID NO. 102) | P011-29 (SEQ ID NO. 176) |
| M29-013 | G004-29 (SEQ ID NO. 103) | P011-29 (SEQ ID NO. 176) |
| M29-014 | G004-29 (SEQ ID NO. 103) | P007-29 (SEQ ID NO. 173) |
| M29-015 | G005-29 (SEQ ID NO. 104) | P011-29 (SEQ ID NO. 176) |
| M29-016 | G005-29 (SEQ ID NO. 104) | P007-29 (SEQ ID NO. 173) |
| M29-017 | G006-29 (SEQ ID NO. 105) | P011-29 (SEQ ID NO. 176) |
| M29-018 | G006-29 (SEQ ID NO. 105) | P007-29 (SEQ ID NO. 173) |
| M29-019 | G007-29 (SEQ ID NO. 106) | P011-29 (SEQ ID NO. 176) |
| M29-020 | G007-29 (SEQ ID NO. 106) | P007-29 (SEQ ID NO. 173) |
| M29-023 | miR-29a-3p (SEQ ID NO. 12) | P008-29 (SEQ ID NO. 174) |
| M29-024 | G009-29 (SEQ ID NO. 127) | P007-29 (SEQ ID NO. 173) |
| M29-025 | G009-29 (SEQ ID NO. 127) | P011-29 (SEQ ID NO. 176) |
| M29-026 | G009-29 (SEQ ID NO. 127) | P005-29 (SEQ ID NO. 171) |
| M29-027 | G010-29 (SEQ ID NO. 128) | P007-29 (SEQ ID NO. 173) |
| M29-028 | G010-29 (SEQ ID NO. 128) | P011-29 (SEQ ID NO. 176) |
| M29-029 | G011-29 (SEQ ID NO. 129) | P007-29 (SEQ ID NO. 173) |
| M29-030 | G011-29 (SEQ ID NO. 129) | P011-29 (SEQ ID NO. 176) |
| M29-031 | G012-29 (SEQ ID NO. 130) | P007-29 (SEQ ID NO. 173) |
| M29-032 | G012-29 (SEQ ID NO. 130) | P011-29 (SEQ ID NO. 176) |
| M29-033 | G014-29 (SEQ ID NO. 131) | P007-29 (SEQ ID NO. 173) |
| M29-034 | G014-29 (SEQ ID NO. 131) | P011-29 (SEQ ID NO. 176) |
| M29-035 | G015-29 (SEQ ID NO. 620) | P011-29 (SEQ ID NO. 176) |
| M29-036 | G015-29 (SEQ ID NO. 620) | P012-29 (SEQ ID NO. 838) |
| M29-037 | G016-29 (SEQ ID NO. 835) | P011-29 (SEQ ID NO. 176) |
| M29-038 | G016-29 (SEQ ID NO. 835) | P012-29 (SEQ ID NO. 838) |
| M29-039 | G007-29 (SEQ ID NO. 106) | P013-29 (SEQ ID NO. 177) |
| M29-040 | G017-29 (SEQ ID NO. 836) | P013-29 (SEQ ID NO. 177) |
| M29-041 | G018-29 (SEQ ID NO. 837) | P014-29 (SEQ ID NO. 839) |
| E1-001 | G001-E1 (SEQ ID NO. 465) | P001-E1 (SEQ ID NO. 466) |

For example, an engineered oligonucleotide or salt thereof can comprise at least about 80% sequence identity to an oligonucleotide of any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949. For example, an engineered oligonucleotide or salt thereof can comprise at least about 90% sequence identity to an oligonucleotide of any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949. In some cases, an engineered oligonucleotide or salt thereof can comprise from about 80% to 100% sequence identity to an oligonucleotide of any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949. In some cases, an engineered oligonucleotide or salt thereof can comprise from about 85% to 100% sequence identity to an oligonucleotide of any one of SEQ ID NOs: 1-5, 12-14, 19-20, 24-25, 28, 30, 32, 34, 36, 38-45, 52-89, 100-154, 184-201, 205-222, 225-233, 235-243, 245443, 445-453, 455-463, 465, 620, 624-825, 835-837, 840-899, and 901-949. In some cases, an engineered oligonucleotide or salt thereof can comprise at least 80% sequence identity to at least about 10 contiguous bases of any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949. In some cases, an engineered oligonucleotide or salt thereof can comprise at least 85% sequence identity to at least about 10 contiguous bases of any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949.

In some cases, the engineered oligonucleotide can comprise at least about: 70%, 75%, 80%, 85%, 90%, 95% sequence identity to any one of SEQ ID NOs: 1-5, 12-14, 19-20, 24-25, 28, 30, 32, 34, 36, 38-45, 100-126, 245-263, 465, 624-643, 840-845, and 901-949, or any combination thereof.

In some cases, a second strand can comprise at least about: 70%, 75%, 80%, 85%, 90%, 95% sequence identity to any one of SEQ ID NOs: 6-11, 15-18, 21-23, 26-27, 29, 31, 33, 35, 37, 46-51, 90-99, 155-183, 202-204, 223-224, 234-244, 444, 454, 464, 466, 838-839, or any combination thereof. In some cases, the second strand can comprise at least about: 70%, 75%, 80%, 85%, 90%, 95% sequence identity to any one of: SEQ ID NOs: 51, 95-99, or any combination thereof.

For example, an engineered oligonucleotide or salt thereof can comprise at least about 80% sequence identity to an oligonucleotide of any one of SEQ ID NO: 587, SEQ ID NO: 588, SEQ ID NO: 589, SEQ ID NO: 500, SEQ ID NO: 513, SEQ ID NO: 518, SEQ ID NO: 476, SEQ ID NO: 481, or SEQ ID NO: 495. For example, an engineered oligonucleotide or salt thereof can comprise at least about 90% sequence identity to an oligonucleotide of any one of SEQ ID NO: 587, SEQ ID NO: 588, SEQ ID NO: 589, SEQ ID NO: 500, SEQ ID NO: 513, SEQ ID NO: 518, SEQ ID NO: 476, SEQ ID NO: 481, or SEQ ID NO: 495. In some cases, an engineered oligonucleotide or salt thereof can comprise from about 80% to 100% sequence identity to an oligonucleotide of any one of SEQ ID NO: 587, SEQ ID NO: 588, SEQ ID NO: 589, SEQ ID NO: 500, SEQ ID NO: 513, SEQ ID NO: 518, SEQ ID NO: 476, SEQ ID NO: 481, or SEQ ID NO: 495. In some cases, an engineered oligonucleotide or salt thereof can comprise from about 85% to 100% sequence identity to an oligonucleotide of any one of SEQ ID NO: 587, SEQ ID NO: 588, SEQ ID NO: 589, SEQ ID NO: 500, SEQ ID NO: 513, SEQ ID NO: 518, SEQ ID NO: 476, SEQ ID NO: 481, or SEQ ID NO: 495. In some cases, an engineered oligonucleotide or salt thereof can comprise at least 80% sequence identity to at least about 10 contiguous bases of any one of SEQ ID NO: 587, SEQ ID NO: 588, SEQ ID NO: 589, SEQ ID NO: 500, SEQ ID NO: 513, SEQ ID NO: 518, SEQ ID NO: 476, SEQ ID NO: 481, or SEQ ID NO: 495. In some cases, an engineered oligonucleotide or salt thereof can comprise at least 85% sequence identity to at least about 10 contiguous bases of any one of SEQ ID NO: 587, SEQ ID NO: 588, SEQ ID NO: 589, SEQ ID NO: 500, SEQ ID NO: 513, SEQ ID NO: 518, SEQ ID NO: 476, SEQ ID NO: 481, or SEQ ID NO: 495.

In some cases, an engineered oligonucleotide or salt thereof can comprise at least about: 1%, 2%, 5%, 7%, 9%, 10%, 11%, 12%, 13%, 14%, 15%, 16%, 17%, 18%, 19%, or 20% lower Gibbs free energy (ΔG) of binding to the RNA sequence at about 37 degrees Celsius and at about pH 7.2. In some cases, an engineered oligonucleotide or salt thereof can bind the RNA sequence at about 18, 19, 20, 21, 22, 23, 24, 25, 26, 27, 28, 29, 30, 31, 32, 33, 34, 35, 36, 37, 38, 39 or 40 degrees Celsius. In some cases, an engineered oligonucleotide or salt thereof can bind the RNA sequence at a pH of about 6.6, 6.7, 6.8, 6.9, 7.0, 7.1, 7.2, 7.3, 7.4, 7.5, 7.6, 7.7, or 7.8.

The terms "administer," "administering", "administration," and the like, as used herein, can refer to methods that can be used to enable delivery of compounds or compositions to the desired site of biological action. Delivery can include direct application to the affect tissue or region of the body. Delivery can include a parenchymal injection, an intra-thecal injection, an intra-ventricular injection, or an intra-cisternal injection. A composition provided herein can be administered by any method. A method of administration can be by inhalation, intraarterial injection, intracerebroventricular injection, intracisternal injection, intramuscular injection, intraorbital injection, intraparenchymal injection, intraperitoneal injection, intraspinal injection, intrathecal injection, intravenous injection, intraventricular injection, stereotactic injection, subcutaneous injection, or any combination thereof. Delivery can include parenteral administration (including intravenous, subcutaneous, intrathecal, intraperitoneal, intramuscular, intravascular or infusion), oral administration, inhalation administration, intraduodenal administration, rectal administration. Delivery can include topical administration (such as a lotion, a cream, an ointment) to an external surface of a surface, such as a skin. In some instances, a subject can administer the composition in the absence of supervision. In some instances, a subject can administer the composition under the supervision of a medical professional (e.g., a physician, nurse, physician's assistant, orderly, hospice worker, etc.). In some cases, a medical professional can administer the composition. In some cases, a cosmetic professional can administer the composition.

The term "subject," "host," "individual," and "patient" are as used interchangeably herein to refer to animals, typically mammalian animals. Any suitable mammal can be administered a composition as described herein (such as an engineered oligonucleotide) or treated by a method as described herein. Non-limiting examples of mammals include humans, non-human primates (e.g., apes, gibbons, chimpanzees, orangutans, monkeys, macaques, and the like), domestic animals (e.g., dogs and cats), farm animals (e.g., horses, cows, goats, sheep, pigs) and experimental animals (e.g., mouse, rat, rabbit, guinea pig). Mammals can be any age or at any stage of development, for example a mammal can be neonatal, infant, adolescent, adult or in utero. In some embodiments a mammal can be a human. Humans can be more than about: 1, 2, 5, 10, 20, 30, 40, 50, 60, 70, 80, 90, or 100 years of age. Humans can be less than about: 1, 2, 5, 10, 20, 30, 40, 50, 60, 70, 80, 90, or 100 years of age. A mammal can be male or female. In some embodiments a subject can be a human. In some embodiments, a subject may be suspected of having a disease or condition. The subject can be a patient, such as a patient being treated for a condition or a disease, such as a cancer, a fibrosis condition, or a viral infection patient. The subject may be predisposed to a risk of developing a condition or a disease such as cancer. The subject may be in remission from a condition or a disease, such as a cancer patient. The subject may be healthy.

The term "mammalian cell" can refer to any mammalian cell, typically a human cell. In some embodiments the human cell can be a cell of head or neck tissue, a skin cell, a cervical cell, a prostate cell, a stem cell, a bone cell, a blood cell, a muscle cell, a fat cell, a nerve cell, an endothelial cell, sperm cell, egg cell, cancer cell, barrier cell, hormone-secreting cell, exocrine-secretory cell, epithelial cell, oral cell, sensory transducer cell, autonomic neuron cell, peripheral neuron cell, central nervous neuron cell, secretory cell, barrier cell, muscle cell, cardiac muscle cell, white blood cell, germ cell, nurse cell, kidney cell, or any combination thereof.

As used herein, cancer refers to a disease caused by an uncontrolled division of abnormal cells in a part of the body. Those cells can be of different types selected from a list maintained by the National Cancer Institute (https://www.cancer.gov/types).

As used herein, "treating" of cancer can include one or more of: reducing the frequency and/or severity of symptoms, elimination of symptoms and/or their underlying cause, and improvement or remediation of damage. For example, treatment of cancer can include, for example, relieving the pain experienced by a mammal suffering from cancer, and/or causing the regression or disappearance of cancer. Treating may also include: reduced malaise, cessation of cancer side effects, abatement of tumors, or any combination thereof. Treating can include administering an engineered oligonucleotide of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, and 840-899, or any combination thereof. As used herein, "treating" of fibrosis, scarring, or both can include one or more of: reducing the frequency and/or severity of symptoms, elimination of symptoms and/or their underlying cause, and improvement or remediation of damage. For example, treatment of fibrosis can include, for example, relieving shortness of breath experienced by a mammal suffering from pulmonary fibrosis, and/or causing the regression or disappearance of fibrosis. Treating may also include: reduced malaise, cessation of fibrosis or scarring side effects, abatement of fibrotic tissue, or any combination thereof. Treating can include administering an engineered oligonucleotide of SEQ ID NOs: 1-5, 12-14, 19-20, 38-45, 52-89, 100-154, 184-201, 620, 624-825, and 835-837, or any combination thereof. As used herein, "treating" of a viral infection can include one or more of: reducing the frequency and/or severity of symptoms, elimination of symptoms and/or their underlying cause, elimination of the infectious disease, and improvement or remediation of damage. For example, treatment of a viral infection can include, for example, relieving the cough experienced by a mammal suffering from a viral infection, and/or causing the regression or disappearance of a viral infection. Treating may also include: reduced malaise, cessation of viral infection side effects, abatement of a viral infection, or any combination thereof. Treating can include administering an engineered oligonucleotide of SEQ ID NOs: 1-5, 12-14, 19-20, 38-45, 52-89, 100-154, 184-201, 620, 624-825, and 835-837, or any combination thereof.

As used herein, "treating" of muscular dystrophy can include one or more of: reducing the frequency and/or severity of symptoms, elimination of symptoms and/or their underlying cause, and improvement or remediation of damage. For example, treatment of muscular dystrophy can include, for example, relieving the muscle weakness experienced by a mammal suffering from muscular dystrophy, and/or causing the regression or disappearance of muscle weakness. Treating may also include: reduced malaise, cessation of myotonia, abatement of muscle pain, or any combination thereof. Treating can include administering an engineered oligonucleotide of SEQ ID NOs: 12-14, 30, 100-154, 235-243, 620, 835-837, and 901-949, or any combination thereof.

TABLE 5

ASOs

| Oligo | Sequence (5'-3') | SEQ ID NO: | Targeted mRNA SEQ ID NOs: |
|---|---|---|---|
| AS-DX-003 | TCCAAACGAGTCTCCG | 901 | 954, 1017, 1046, 1112 |
| AS-DX-004 | GATTCTGAAACCAGA | 902 | 958, 994, 1004, 1040, 1057, 1111 |
| AS-DX-005 | GCGGGCGCCCTGCCAC | 903 | 1030, 1047, 1104 |
| AS-DX-006 | TCATCCAGCAGCAGGC | 904 | 981, 1025, 1068, 1069, 1113 |
| AS-DX-007 | TAGCCAGCCAGGTGTT | 905 | 966, 967, 997, 1056 |
| AS-DX-008 | CAGCGTCGGAAGGTGG | 906 | 955, 999, 1071, 1092, 1118 |
| AS-DX-009 | TAGACAGCGTCGGAAG | 907 | 1021, 1051, 1094 |
| AS-DX-010 | ATAGGATCCACAGGGA | 908 | 1032, 1065, 1107 |
| AS-DX-011 | TCTATAGGATCCACAG | 909 | 1032, 1067, 1075, 1106 |
| AS-DX-012 | GCACTAATCATCCAGG | 910 | 957, 1035, 1042 |
| AS-DX-014 | CAGCGTCGGAAGGTG | 911 | 955, 999, 1071, 1092, 1118 |
| AS-DX-015 | CCTAGACAGCGTCGGAAGGT | 912 | 955, 999, 1071, 1092, 1118 |
| AS-DX-018 | ATAGGATCCACAGGGAGG | 913 | 1012, 1065 |
| AS-DX-019 | CGGCTCTGGGATCCCCGG | 914 | 973, 1011 |
| AS-DX-021 | GGGGCGGAGACACGCCC | 915 | 986, 1028 |
| AS-DX-022 | AGAAGGCAGGAATCCCAG | 916 | 976, 1019 |
| AS-DX-023 | GCAGGAATCCCAGGCCGG | 917 | 972, 1010 |
| AS-DX-025 | GGAGTCTCTCACCGGGCC | 918 | 984, 1026, 1076 |
| AS-DX-036 | GCGAGGCGGCCTCTTCCG | 919 | 964, 989, 1033, 1064 |
| AS-DX-037 | GCCTCCAGCTCCCCCGGG | 920 | 980, 992, 1024 |
| AS-DX-038 | GGTGTCGGGAGGGCCAT | 921 | 1006, 1039, 1108 |
| AS-DX-055 | CGGTATTCTTCCTCGCTG | 922 | 952, 963, 991, 1036, 1082 |
| AS-DX-060 | GGGCATTTTAATATATCTCTGAACT | 923 | 1003, 1074, 1085 |

TABLE 5-continued

ASOs

| Oligo | Sequence (5'-3') | SEQ ID NO: | Targeted mRNA SEQ ID NOs: |
|---|---|---|---|
| AS-DX-061 | TATCTTCTGAACTAATCATCCA | 924 | 957, 1035, 1042 |
| AS-DX-062 | CAGGAGATGTAACTCTAATCCAG | 925 | 1018, 1059, 1090, 1101, 1105, 1119 |
| AS-DX-063 | CTCTCACCGGGCCTAGACCTAGAAG | 926 | 987, 1034, 1077, 1109 |
| AS-DX-064 | TGCGCACTGCGCGCAGGTCTAGCCA | 927 | 1014, 1043, 1091, 1103 |
| AS-DX-065 | ACTGCGCGCAGGTCTAGCCAGGAAG | 928 | 1031, 1001, 1072, 1084, 1089 |
| AS-DX-066 | CGGGGTGCGCACTGCGCGCAGGTCT | 929 | 998, 1048, 1049, 1050, 1097, 1102 |
| AS-DX-067 | TGCGCACTGCGCGCAGGTCTAGCCAGGAAG | 930 | 960, 978, 1001 |
| AS-DX-068 | ACTGCGCGCAGGTCTAGCCAGGAAGCGGGC | 931 | 974, 1031, 1089, 1110 |
| AS-DX-069 | ACCCGACCCCGTCCCAACCCCGCGT | 932 | 968, 1000, 1081, 1095 |
| AS-DX-070 | TGGGCTGGTGGAGAGGCAG | 933 | 975, 1013, 1054, 1120 |
| AS-DX-074 | TTCCCTGCATGTTTCCGGGTGCCCG | 934 | 983, 1061 |
| AS-DX-075 | CTTCCCTGCATGTTTCCGG | 935 | 971, 1063 |
| AS-DX-076 | TGTGGCTCTCGTTCATTTC | 936 | 977, 1096 |
| AS-DX-077 | CTCCGTGGGAGTCTTGAGTGTGCCA | 937 | 950, 961, 982, 1070, 1073 |
| AS-DX-078 | TGGAACTGAACCTCCGTGG | 938 | 965, 988, 1066 |
| AS-DX-080 | CACCCCTTCATGAATGGCGCC | 939 | 979, 995, 1052, 1083 |
| AS-DX-081 | ACAGGCTCCACCCCTTCATG | 940 | 970, 1044, 1045, 1088, 1114 |
| AS-DX-082 | TTCCGCTCAAAGCAGGCCTC | 941 | 953, 1022, 1116 |
| AS-DX-083 | AAAGCGATCCTTCTCAAAGGCTCGG | 942 | 993, 1023, 1041, 1078 |
| AS-DX-084 | CCTGCGCGGGCGCCCTGCCGC | 943 | 951, 1030, 1098, 1115 |
| AS-DX-085 | TATCTCTGAACTAATCATC | 944 | 956, 1005, 1053 |
| AS-DX-086 | AGCGCCTGGCGGCGGAACGCAGACC | 945 | 990, 1058, 1093 |
| AS-DX-087 | ATCTCTGCCCGCCTTCCCTCCCGCC | 946 | 985, 1087, 1100 |
| AS-DX-088 | AAACCAGATCTGAATCCTGGAC | 947 | 959, 962, 1029, 1055, 1060 |
| AS-DX-089 | TTTCTAGGAGAGGTTGCGCCTG | 948 | 969, 1008, 1079 |

TABLE 5-continued

ASOs

| Oligo | Sequence (5'-3') | SEQ ID NO: | Targeted mRNA SEQ ID NOs: |
|---|---|---|---|
| AS-DX-097 | CCTAGACAGCGTCGGAAGGTAG | 949 | 955, 999, 1071, 1092, 1118 |

A regulatory non-coding RNA (ncRNA) comprises short non-coding RNA sequences expressed in a genome that regulates expression or function of other biomolecules in mammalian cells. An ncRNA is generally <200 nucleotides in length and can be single stranded or double stranded, and may form non-linear secondary or tertiary structures. An ncRNA can comprise exogenously derived small interfering RNA (siRNA), MicroRNA (miRNA), small nuclear RNA (U-RNA), Small nucleolar RNA (snoRNA), Piwi-interacting RNA (piRNA), repeat associated small interfering RNA (rasiRNA), small rDNA-derived RNA (srRNA), transfer RNA derived small RNA (tsRNA), ribosomal RNA derived small RNA (rsRNA), large non-coding RNA derived small RNA (lncsRNA), or a messenger RNA derived small RNA (msRNA).

An engineered oligonucleotide can comprise DNA or RNA. In some cases, an engineered oligonucleotide can comprise a plurality of nucleotides. In some cases, an engineered oligonucleotide can comprise an artificial nucleic acid analogue. In some cases, an engineered oligonucleotide can comprise DNA, can comprise cell-free DNA, cDNA, fetal DNA, viral DNA, or maternal DNA. In some cases, an engineered oligonucleotide can comprise an shRNA, or siRNA, an ncRNA mimic, a short-harpin RNA (shRNA), a dicer-dependent siRNA (di-siRNA), an antisense oligonucleotide (ASO), a gapmer, a mixmer, double-stranded RNAs (dsRNA), single stranded RNAi, (ssRNAi), DNA-directed RNA interference (ddRNAi), an RNA activating oligonucleotide (RNAa), or an exon skipping oligonucleotide. In some cases, an engineered oligonucleotide can comprise a completely synthetic miRNA. A completely synthetic miRNA is one that is not derived or based upon an ncRNA. Instead, a completely synthetic miRNA may be based upon an analysis of multiple potential target sequences or may be based upon isolated natural non-coding sequences that are not ncRNAs. One example of a completely synthetic miRNA is E1-001 (Table 4).

A diagnostic test can comprise an imaging procedure, a blood count analysis, a tissue pathology analysis, a biomarker analysis, a biopsy, a magnetic resonance image procedure, a physical examination, a urine test, an ultrasonography procedure, a genetic test, a liver function test, a positron emission tomography procedure, a X-ray, serology, an angiography procedure, an electrocardiography procedure, an endoscopy, a diagnostic polymerase chain reaction test (PCR), a pap smear, a hematocrit test, a skin allergy test, a urine test, a colonoscopy, an enzyme-linked immunosorbent assay (ELISA), microscopy analysis, bone marrow examination, rapid diagnostic test, pregnancy test, organ function test, toxicology test, infectious disease test, bodily fluids test, or any combination thereof.

A pharmaceutical composition can comprise a first active ingredient. The first active ingredient can comprise an engineered oligonucleotide as described herein. The pharmaceutical composition can be formulated in unit dose form. The pharmaceutical composition can comprise a pharmaceutically acceptable excipient, diluent, or carrier. The pharmaceutical composition can comprise a second, third, or fourth active ingredient, such as a second engineered oligonucleotide.

A composition described herein can compromise an excipient. An excipient can comprise a pH agent (to minimize oxidation or degradation of a component of the composition), a stabilizing agent (to prevent modification or degradation of a component of the composition), a buffering agent (to enhance temperature stability), a solubilizing agent (to increase protein solubility), or any combination thereof. An excipient can comprise a surfactant, a sugar, an amino acid, an antioxidant, a salt, a non-ionic surfactant, a solubilizer, a triglyceride, an alcohol, or any combination thereof. An excipient can comprise sodium carbonate, acetate, citrate, phosphate, poly-ethylene glycol (PEG), human serum albumin (HSA), sorbitol, sucrose, trehalose, polysorbate 80, sodium phosphate, sucrose, disodium phosphate, mannitol, polysorbate 20, histidine, citrate, albumin, sodium hydroxide, glycine, sodium citrate, trehalose, arginine, sodium acetate, acetate, HCl, disodium edetate, lecithin, glycerin, xanthan rubber, soy isoflavones, polysorbate 80, ethyl alcohol, water, teprenone, or any combination thereof. An excipient can be an excipient described in the Handbook of Pharmaceutical Excipients, American Pharmaceutical Association (1986).

Administration or application of a composition disclosed herein can be performed for a treatment duration of at least about at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 days consecutive or nonconsecutive days. In some cases, a treatment duration can be from about 1 to about 30 days, from about 2 to about 30 days, from about 3 to about 30 days, from about 4 to about 30 days, from about 5 to about 30 days, from about 6 to about 30 days, from about 7 to about 30 days, from about 8 to about 30 days, from about 9 to about 30 days, from about 10 to about 30 days, from about 11 to about 30 days, from about 12 to about 30 days, from about 13 to about 30 days, from about 14 to about 30 days, from about 15 to about 30 days, from about 16 to about 30 days, from about 17 to about 30 days, from about 18 to about 30 days, from about 19 to about 30 days, from about 20 to about 30 days, from about 21 to about 30 days, from about 22 to about 30 days, from about 23 to about 30 days, from about 24 to about 30 days, from about 25 to about 30 days, from about 26 to about 30 days, from about 27 to about 30 days, from about 28 to about 30 days, or from about 29 to about 30 days.

Administration or application of a composition disclosed herein can be performed for a treatment duration of at least about 1 week, at least about 1 month, at least about 1 year, at least about 2 years, at least about 3 years, at least about 4 years, at least about 5 years, at least about 6 years, at least about 7 years, at least about 8 years, at least about 9 years, at least about 10 years, at least about 15 years, at least about 20 years, or more. Administration can be performed repeatedly over a lifetime of a subject, such as once a month or once a year for the lifetime of a subject. Administration can be performed repeatedly over a substantial portion of a subject's life, such as once a month or once a year for at least about 1 year, 5 years, 10 years, 15 years, 20 years, 25 years, 30 years, or more.

Administration or application of composition disclosed herein can be performed at least 1, 2, 3, 4, 5, 6, 7, 8, 9, 10, 11, 12, 13, 14, 15, 16, 17, 18, 19, 20, 21, 22, 23, or 24 times a day. In some cases, administration or application of composition disclosed herein can be performed at least 1, 2, 3, 4, 5, 6, 7, 8, 9, 10, 11, 12, 13, 14, 15, 16, 17, 18, 19, 20, or 21 times a week. In some cases, administration or application of composition disclosed herein can be performed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, or 90 times a month.

In some cases, a composition can be administered/applied as a single dose or as divided doses. In some cases, the compositions described herein can be administered at a first time point and a second time point. In some cases, a composition can be administered such that a first administration is administered before the other with a difference in administration time of 1 hour, 2 hours, 4 hours, 8 hours, 12 hours, 16 hours, 20 hours, 1 day, 2 days, 4 days, 7 days, 2 weeks, 4 weeks, 2 months, 3 months, 4 months, 5 months, 6 months, 7 months, 8 months, 9 months, 10 months, 11 months, 1 year or more.

In some cases, an engineered oligonucleotide or salt thereof comprising a modification when contacted with an mRNA sequence can produce lower activity of a polypeptide encoded by the mRNA sequence as compared to contacting an equivalent amount of an otherwise comparable oligonucleotide that lacks the modification with the mRNA sequence. In some cases, the lower activity can be at least about 1.2-fold lower. In some cases, the lower activity can be at least about 1.5-fold lower. In some cases, the lower activity can be at least about 1.7-fold lower. In some cases, the lower activity can be at least about 2.0-fold lower. In some cases, the lower activity can be about: 1.2, 1.3, 1.4, 1.5, 1.6, 1.7, 1.8, 1.9, 2.0, 2.1, 2.2, 2.3, 2.4, 2.5-fold lower. In some cases, the lower activity can be from about 1.2-fold to about 2.0-fold lower. In some cases, the lower activity can be from about 1.1-fold to about 1.5-fold lower. In some cases, the lower activity can be from about 1.1-fold to about 2.5-fold lower. In some cases, the lower activity can be from about 1.2-fold to about 3.0-fold lower. In some cases, the lower activity can be at least about 1.2-fold to about at least 10-fold lower expression. In some cases, the lower activity can be at least about 14-fold lower. In some cases, the lower expression can be at least about 18-fold lower expression. In some cases, the lower activity can be about: 1.2, 2, 3, 4, 5, 6, 7, 8, 9, 10, 11, 12, 13, 14, 15, 16, 17, 18, 19, 20-fold lower. In some cases, the lower activity can be from about 1.2-fold to about 14-fold. In some cases, the lower activity can be from about 1.1-fold to about 20-fold lower. In some cases, the lower activity can be from about 1.2-fold to about 30-fold lower.

In some cases, an engineered oligonucleotide or salt thereof comprising a modification when stored in a closed container placed in a room for a time period will remain at least about 80% of an initial amount of the engineered oligonucleotide or salt thereof. In some cases, the engineered oligonucleotide will remain at least about 70% the initial amount. In some cases, the engineered oligonucleotide will remain at least about 90% the initial amount. In some cases, the engineered oligonucleotide will remain at least about: 60%, 65%, 70%, 75%, 80%, 85%, 90%, 95%, 99%. In some cases, the engineered nucleotide can be at least about 60% to about at least 80%. In some cases, the engineered nucleotide can be at least about 80% to at least about 99%. In some cases, the time period of storage can be at least 1 month. In some cases, the time period of storage can be at least about 3 months. In some cases, the time period of storage can be at least about 1 year. In some cases, the time period of storage can be at least about 1, 2, 4, 6, 8, 12, 18, 24, 36, 48 or 60 months. In some cases, the time period of storage can be at least about 1 month to about at least 1 year. In some cases, the time period of storage can be at least about 6 months to at least about 2 years. In some cases, the time period of storage can be at least about 1 month to at least about 5 years.

The term "tissue" as used herein, can be any tissue sample. A tissue can be a tissue suspected or confirmed of having a disease or condition. A tissue can be a sample that may be substantially healthy, substantially benign, or otherwise substantially free of a disease or a condition. A tissue can be a tissue removed from a subject, such as a tissue biopsy, a tissue resection, an aspirate (such as a fine needle aspirate), a tissue washing, a cytology specimen, a bodily fluid, or any combination thereof. A tissue can comprise cancerous cells, tumor cells, non-cancerous cells, or a combination thereof. A tissue can comprise a blood sample (such as a cell-free DNA sample). A tissue can be a sample that may be genetically modified.

In some cases, a disease or condition can comprise a viral infection, a fibrosis condition, a cancer, a muscular dystrophy, or any combination thereof. In some cases, the disease or condition can comprise the viral infection. The viral infection can comprise a SARS-CoV infection, a SARS-CoV-2 infection, a MERS-CoV infection, a CoV-HKU1 infection, an HIV infection, an HCV infection, or any combination thereof. The viral infection can comprise a coronavirus infection. A coronavirus can be a SARS-CoV, a SARS-CoV-2, a CoV-HKU1, or a MERS-CoV. In some cases, the viral infection can comprise an HCV genotype 1 infection. In some cases, at least a portion of the RNA sequence can be encoded by a SARS-CoV genome, a MERS-CoV genome, a CoV-HKU1 genome, an HIV genome, or any combination thereof. In some cases, an engineered oligonucleotide can be selective for an RNA sequence. In some cases, an RNA sequence can comprise at least about: 70%, 75%, 80%, 85%, 90%, 95% sequence identity to an RNA sequence of SEQ ID NOS: 500-531, 829-831 (Table 6), SEQ ID NOS: 474-499, 826-828 (Table 6), SEQ ID NOS: 532-554 (Table 6), SEQ ID NOS: 555-586 (Table 6), or any combination thereof. In some cases, a subject may suffer from a SARS-CoV-2 infection and the RNA sequence can comprise at least about: 70%, 75%, 80%, 85%, 90%, 95% sequence identity to an RNA sequence of SEQ ID NOS: 500-531, 829-831 (Table 6). In some cases, a subject may suffer from a SARS-CoV infection and the RNA sequence can comprise at least about: 70%, 75%, 80%, 85%, 90%, 95% sequence identity to an RNA sequence of SEQ ID NOS: 474-499, 826-828 (Table 6). In some cases, a subject may suffer from a MERS-CoV infection and the RNA sequence can comprise at least about: 70%, 75%, 80%, 85%, 90%, 95% sequence identity to an RNA sequence of SEQ ID NOS: 532-554 (Table 6). In some cases, a subject may suffer from a CoV-HKU1 infection and the RNA sequence can comprise at least about: 70%, 75%, 80%, 85%, 90%, 95% sequence identity to an RNA sequence of SEQ ID NOS: 555-586 (Table 6). In some cases, at least a portion of the RNA sequence can be encoded in an HIV genome. In some cases, the RNA sequence can comprise at least about: 75%, 80%, 85%, 90%, 95% or more sequence identity to SEQ ID NO: 470, as determined by a BLAST pairwise sequence alignment algorithm. In some cases, the viral infection can be an HIV infection. In some cases, the RNA sequence can comprise at least about: 70%, 75%, 80%, 85%, 90%, 95% or more sequence identity to SEQ ID NO: 471, SEQ ID NO: 472, or SEQ ID NO: 473, as determined by a BLAST pairwise sequence alignment algorithm.

TABLE 6

Target sequences

| Name | Sequence | SEQ ID NO |
|---|---|---|
| ITGA6 3'UTR | AUUCUUAGUCACAAA AUAUAUUUUGUUUAC AA | 467 |
| SERPINEI 3'UTR | AUUUUGGAGUGUAGG UGACUUGUUUACU | 468 |
| EGFR 3'UTR | UAGACCCACAGACUG GUUUUGCAACGUUUA CAC | 469 |
| HIV-1 NEF site | UCCACUGACCUUUGG AUGGUGCUA | 470 |
| TET1 3' UTR site 01 | UCACUCAGUUUGGUG CUU | 471 |
| TET1 3' UTR site 02 | ACUCUACACAGCUUC UGGUGCUU | 472 |
| TET1 3' UTR site 03 | GUAUGGAAAACCUAA UGGUGCUU | 473 |
| SARS-CoV Site 01 | CUCAUGGAAAGUGAA CUUGUCAUUGGUGCU G | 474 |
| SARS-CoV Site 02 | UCCUUCCCACAAGCA GCCCCGCAUGGUGUU G | 475 |
| SARS-CoV Site 03 | ACUGCCACUGCUGGA UGGACAUUGGUGCU G | 476 |
| SARS-CoV Site 04 | AUUGUGGCUUAUACU AUGUCUUUAGGUGCU G | 477 |
| SARS-CoV Site 05 | AGACAAAUAGCGCCA GGACAAACUGGUGUU A | 478 |
| SARS-CoV Site 06 | UACAACAUGAGAGUU AUUCACUUUGGUGCU G | 479 |
| SARS-CoV Site 07 | GACCUUUUUAGAAAC GCCCGUAAUGGUGUU U | 480 |
| SARS-CoV Site 08 | UGUAUUACACGAUGC AAUUUAGGUGGUGCU G | 481 |

TABLE 6 -continued

Target sequences

| Name | Sequence | SEQ ID NO |
|---|---|---|
| SARS-CoV Site 09 | ACACAUCACGAUAAA UUCACUGAUGGUGUU U | 482 |
| SARS-CoV Site 10 | CCACAUACAGUCUUG CAGGCUGUAGGUGCU U | 483 |
| SARS-CoV Site 11 | CUAGUAAGAAAAAUA UUUGUAGAUGGUGUU C | 484 |
| SARS-CoV Site 12 | AACAUGGACCAAGAG UCCUUUGGUGGUGCU U | 485 |
| SARS-CoV Site 13 | CUUAAACAACCUAAA UAGAGGUAUGGUGCU G | 486 |
| SARS-CoV Site 14 | UUGUCUGUUUUGCUA UCCAUGCAGGGUGCU G | 487 |
| SARS-CoV Site 15 | AACCGUUACUUCAGG CUUACUCUUGGUGUU U | 488 |
| SARS-CoV Site 16 | UUUGAUGUUGUUAGA CAAUGCUCUGGUGUU A | 489 |
| SARS-CoV Site 17 | GCAUGCUACAAUGGU UCACCAUCUGGUGUU U | 490 |
| SARS-CoV Site 18 | GCUCUAAAUGACUUU AGCAACUCAGGUGCU G | 491 |
| SARS-CoV Site 19 | UUUACUCCUCUUGUG CAACCUGUGGGUGCU U | 492 |
| SARS-CoV Site 20 | UUUGGUGUACUCUUA UCUAAUUUUGGUGCU C | 493 |
| SARS-CoV Site 21 | AGACAACGUUCAAAC CAAACACUUGGUGUU U | 494 |
| SARS-CoV Site 22 | CACUAUUCAGCGAGU UUCAAGAAAGGUGCU A | 495 |
| SARS-CoV Site 23 | CAGUUUGGUCCAACA UACUUGGAUGGUGCU G | 496 |
| SARS-CoV Site 24 | CCAUUGUUGUCAGCA GGCAUAUUUGGUGCU A | 497 |
| SARS-CoV Site 25 | UGUGGUUUUCCCUCA CAGGCUGCUGGUGUU A | 498 |
| SARS-CoV Site 26 | GUUACCAAGGGAAAG CCCGUAAAAGGUGCU U | 499 |
| SARS-CoV Site 27 | AUUUUAGAAGAUGAG UUUACA | 826 |

TABLE 6 -continued

Target sequences

| Name | Sequence | SEQ ID NO |
|---|---|---|
| SARS-CoV Site 28 | AUUUAGGUGGUGCUGUUUGCA | 827 |
| SARS-CoV Site 29 | CUUCCUUCAGGCUGUUUGC | 828 |
| SARS CoV-2 Site 01 | GGGCCAGAAGCUGGACUUCCCUAUGGUGCUA | 500 |
| SARS CoV-2 Site 02 | UCAACUCAAUUGAGUACAGACACUGGUGUUG | 501 |
| SARS CoV-2 Site 03 | ACUUCUGGUUGGACCUUUGGUGCAGGUGCUG | 502 |
| SARS CoV-2 Site 04 | UCAUAUGGUUUCCAACCCACUAAUGGUGUUG | 503 |
| SARS CoV-2 Site 05 | CAGGCCGGUAGCACACCUUGUAAUGGUGUUG | 504 |
| SARS CoV-2 Site 06 | GAUUCUUCUUCAGGUUGGACAGCUGGUGCUG | 505 |
| SARS CoV-2 Site 07 | AACCCUGUCCUACCAUUUAAUGAUGGUGUUU | 506 |
| SARS CoV-2 Site 08 | GCAUACACUAAUUCUUUCACACGUGGUGUUU | 507 |
| SARS CoV-2 Site 09 | UAUAAUAUGAGAGUUAUACAUUUUGGUGCUG | 508 |
| SARS CoV-2 Site 10 | UUCAAUUAUUAUAAGAAAGUUGAUGGUGUUG | 509 |
| SARS CoV-2 Site 11 | GACUUAUUUAGAAAUGCCCGUAAUGGUGUUC | 510 |
| SARS CoV-2 Site 12 | GCUCCAGCACAUAUAUCUACUAUUGGUGUUU | 511 |
| SARS CoV-2 Site 13 | AACACUGUUUACACAAAAGUUGAUGGUGUUG | 512 |
| SARS CoV-2 Site 14 | UGUAUAACACGUUGCAAUUUAGGUGGUGCUG | 513 |
| SARS CoV-2 Site 15 | AAUUCACAGACUUCAUUAAGAUGUGGUGCUU | 514 |
| SARS CoV-2 Site 16 | CUAGUGAGAAAAAUAUUUGUUGAUGGUGUUC | 515 |
| SARS CoV-2 Site 17 | CUUUCUGUUUUGCUUUCCAUGCAGGGUGCUG | 516 |
| SARS CoV-2 Site 18 | AACCGCUACUUUAGACUGACUCUUGGUGUUU | 517 |
| SARS CoV-2 Site 19 | ACAGCAAGAACUGUGUAUGAUGAUGGUGCUA | 518 |
| SARS CoV-2 Site 20 | GCUUGUUACAAUGGUUCACCAUCUGGUGUUU | 519 |
| SARS CoV-2 Site 21 | CUAAAGAGACGUGUAGUCUUUAUGGUGUUU | 520 |
| SARS CoV-2 Site 22 | ACACCAGUUUACUCAUUCUUACCUGGUGUUU | 521 |
| SARS CoV-2 Site 23 | UUUACACCACUAAUUCAACCUAUUGGUGCUU | 522 |
| SARS CoV-2 Site 24 | GGCACUUGUGAAAGAUCAGAAGCUGGUGUUU | 523 |
| SARS CoV-2 Site 25 | GAAAACAUGACACCCCGUGACCUUGGUGCUU | 524 |
| SARS CoV-2 Site 26 | GUCGAAUGUACAACUAUUGUUAAUGGUGUIA | 525 |
| SARS CoV-2 Site 27 | AAACCAGUUACUUAUAAAUUGGAUGGUGUUG | 526 |
| SARS CoV-2 Site 28 | AAAGAAACUUUGUAUUGCAUAGACGGUGCUU | 527 |
| SARS CoV-2 Site 29 | AUACAAGAGGGUGUGGUUGAUUAUGGUGCUA | 528 |
| SARS CoV-2 Site 30 | CCAUUAUUAUCAGCUGGUAUUUUGGUGCUG | 529 |
| SARS CoV-2 Site 31 | GUUGUAAUGGCCUACAUUACAGGUGGUGUUG | 530 |
| SARS CoV-2 Site 32 | AACUGGAACACUAAACAUAGCAGUGGUGUUA | 531 |
| SARS CoV-2 Site 33 | ACCAUCUGGUGUUUAC | 829 |
| SARS CoV-2 Site 34 | GUCAGUUAGGUGGUUUACA | 830 |
| SARS CoV-2 Site 35 | UUUGUGCUUGCUGCUGUUUACA | 831 |
| MERS-CoV Site 01 | AUUAAUAGUGUGGUCCAAAAGGAUGGUGUUG | 532 |

TABLE 6 -continued

Target sequences

| Name | Sequence | SEQ ID NO |
|---|---|---|
| MERS-CoV Site 02 | CUUAAGCAUGGCGGU GGUAUCGCUGGUGCU A | 533 |
| MERS-CoV Site 03 | CAGCUUGGAUGCGUU UUCUUUAAUGGUGCU G | 534 |
| MERS-CoV Site 04 | AUGGCUUAUGGCAAU UGCACAUUUGGUGCU C | 535 |
| MERS-CoV Site 05 | CAAACCGUUCUGCAA UGUGUAAUUGGUGCU U | 536 |
| MERS-CoV Site 06 | CAAAUUGUCUUGCGU AAUUCUAAUGGUGCU U | 537 |
| MERS-CoV Site 07 | UUCACUGCUAACAAA AUUGUUGGUGGUGCU C | 538 |
| MERS-CoV Site 08 | GUUGCAGUAAUUGCU GGAGUUGCUGGUGCU C | 539 |
| MERS-CoV Site 09 | UUUAACAAGUAUAAG UACUUCUCUGGUGCU A | 540 |
| MERS-CoV Site 10 | CAUAUAGAACAUCCU GAUGUCUCUGGUGUU U | 541 |
| MERS-CoV Site 11 | UUUGUUGAAAAUCCC AGUGUUAUUGGUGUU U | 542 |
| MERS-CoV Site 12 | UCGCUUGGCAAAUGA GUGUGCUCAGGUGCU A | 543 |
| MERS-CoV Site 13 | ACUGCUAAUGUCAGU GCACUUAUGGGUGCU A | 544 |
| MERS-CoV Site 14 | AGCUGGAUAGGCUUC GAUGUUGAGGGUGCU C | 545 |
| MERS-CoV Site 15 | GUGAACUUUGUUGUU CAGCCAGUUGGUGUU G | 546 |
| MERS-CoV Site 16 | UCUCUGCAUCAGGUU UCCGCCUUUGGUGCU A | 547 |
| MERS-CoV Site 17 | GUUGUUAAACAAGGC CAUUUUAUUGGUGUU G | 548 |
| MERS-CoV Site 18 | GGUCCGAUUAUGCU UACUUCAAUGGUGCU A | 549 |
| MERS-CoV Site 19 | ACUAUUAAAGAAAAU AUAGAUGGUGGUGCU A | 550 |

TABLE 6 -continued

Target sequences

| Name | Sequence | SEQ ID NO |
|---|---|---|
| MERS-CoV Site 20 | AAUUGCGUGGAAUAU UCCCUCUAUGGUGUU U | 551 |
| MERS-CoV Site 21 | UCCCUCUAUGGUGUU UCGGGCCGUGGUGUU U | 552 |
| MERS-CoV Site 22 | GCUAGCGAGCUAUCU AAUACUUUUGGUGCU A | 553 |
| MERS-CoV Site 23 | CUCAAAAUGGCUGGC AUGCAUUUCGGUGCU U | 554 |
| CoV-HKU1 Site 01 | AGUGAAGUUAAAGCC CAAUCAUCUGGUGUU A | 555 |
| CoV-HKU1 Site 02 | AAUCUUGAACAAAAU CAUAUUCUUGGUGUU A | 556 |
| CoV-HKU1 Site 03 | UUGAUAUUAAUGCGU AUGCUAAUUGGUGUU G | 557 |
| CoV-HKU1 Site 04 | AUAGAUGUUUUGCUU ACUGUAGAUGGUGUU A | 558 |
| CoV-HKU1 Site 05 | GGUAUUAAACAAGAA AGUCGUGUUGGUGUU G | 559 |
| CoV-HKU1 Site 06 | GAUUUAGGUGUUCUU AUACAGAAUGGUGCU A | 560 |
| CoV-HKU1 Site 07 | GCUAGUUUUAAAGUU AUUGAUAAUGGUGUU G | 561 |
| CoV-HKU1 Site 08 | CCACAUCCUUAUUGU UAUUCAGAUGGUGUU A | 562 |
| CoV-HKU1 Site 09 | CAUUUGCAAUGGAUU GUUAUGUAUGGUGCU A | 563 |
| CoV-HKU1 Site 10 | UUAUUUCAUAUUGU AGGAAAAUGGUGUU A | 564 |
| CoV-HKU1 Site 11 | CCUUACACUCCAAAA UAUACUUUUGGUGUU G | 565 |
| CoV-HKU1 Site 12 | UCUGACGUUUAUCAA CAAUUGGCUGGUGUU A | 566 |
| CoV-HKU1 Site 13 | AUGUAUAUUAAUACA CAUAUGAUUGGUGUU A | 567 |
| CoV-HKU1 Site 14 | UCUUCAACAAUUAGA UUGCAGGCUGGUGUU G | 568 |

TABLE 6 -continued

Target sequences

| Name | Sequence | SEQ ID NO |
|---|---|---|
| CoV-HKU1 Site 15 | UAUUAUGAGUUGACUAAAAGUUGUGGUGUUG | 569 |
| CoV-HKU1 Site 16 | ACUUUAGUAAAAGUAGGUUUAGUUGGUGUUU | 570 |
| CoV-HKU1 Site 17 | CUUGUUAGACAAAUUUUUGUAGAUGGUGUUC | 571 |
| CoV-HKU1 Site 18 | UUGAAGAGUAUAGCAGCUACUCGUGGUGUUC | 572 |
| CoV-HKU1 Site 19 | AGUAUGAUGAUUUUGAGUGAUGAUGGUGUUG | 573 |
| CoV-HKU1 Site20 | UUUUGAUAAAAUGAAUUAACUAAUGGUGUUU | 574 |
| CoV-HKU1 Site 21 | CCAUUGCAAAUAGGUUUUUCAACUGGUGUUG | 575 |
| CoV-HKU1 Site22 | UGUAUCACACGAUGUAAUUUAGGUGGUGCUG | 576 |
| CoV-HKU1 Site23 | GUACUUUUUGAUGGUCGUGACAAUGGUGCUU | 577 |
| CoV-HKU1 Site24 | GAAGCUUUUAGAAAAGCAAGAAAUGGUGUUU | 578 |
| CoV-HKU1 Site25 | AGAAAUAGUACAACAUGGAAUGGUGGUGCUU | 579 |
| CoV-HKU1 Site26 | UUUACAGGUUAUUUUCCUAAAUCGGUGCUA | 580 |
| CoV-HKU1 Site 27 | UAUUUUCAUUUUUAUCAAGAACGUGGUGUUU | 581 |
| CoV-HKU1 Site 28 | ACUCAAUCUUUUGCACCUAAUACGGUGUUU | 582 |
| CoV-HKU1 Site29 | UAUUCUAACACUGAAGUUUCUACUGGUGUUU | 583 |
| CoV-HKU1 Site 30 | UUACAACAAUUAUUUAAUAAAUUUGGUGCUA | 584 |
| CoV-HKU1 Site 31 | GACACCUCUCAUAAGAAUAAUUUUGGUGUUA | 585 |
| CoV-HKU1 Site 32 | CUUGCUGAAUUAGCCCCUACACCAGGUGCUU | 586 |

TABLE 6 -continued

Target sequences

| Name | Sequence | SEQ ID NO |
|---|---|---|
| HCV-1 Site 01 | GAUGUAUGGAGAAAAGUAUCCAGUGGUGUUG | 587 |
| HCV-1 Site 02 | GAAGGCAAAGACAGCUAUUGAAAUGGUGUUA | 588 |
| HCV-1 Site 03 | GCAUCUUGUCUGGAGAGACAAUUUGGUGUUU | 589 |
| ZEB1 3' UTR | UGUUUGAAUAUGUGGUAACAUAUGAAGGA | 590 |
| E2F1 3' UTR | UGUGCAUGUACCGGGGAAUGAAGGU | 591 |
| HER3 3' UTR | UUCACAGGCACUCCUGGAGAUAUGAAGGA | 592 |
| SHIP2 3' UTR | GGGGCGGGUGUCCGUCCGGAAAUGAAGGA | 593 |
| CSNK1G1 3' UTR Site 1 | UGAAUUUCAUUCAUCUUCUCAG | 594 |
| CSNK1G1 3' UTR Site 2 | AAGGUCUGAAAUUAUCUUCUCAA | 595 |
| CSNK1G1 3' UTR Site 3 | AUGUGUGGAGUUACUCUUCUCAU | 596 |
| CSNK1G1 3' UTR Site 4 | AAGCAUGGCUUGCAUUUCUCAAA | 597 |
| CSNK1G1 3' UTR Site 5 | CAGCCAAGAAAACGUCUUCUCAG | 598 |
| CSNK1G1 3' UTR Site 6 | GGUAGUUGACAUAUUUUCUCAAA | 599 |
| ARHGAP26 3' UTR Site 01 | CGAGUUUUGUCUUUCUUCUCAG | 600 |
| ARHGAP26 3' UTR Site 02 | GAGAUACAAUCCAGUCUUCUCAU | 601 |
| ARHGAP26 3' UTR Site 03 | UCUUAGAAUGUUCAGUUCUCAAU | 602 |
| ARHGAP26 3' UTR Site 04 | UCACAUACUAUUACGCUUCUCAA | 603 |
| ARHGAP26 3' UTR Site 05 | AAGUCAGCAGGAUGUCUUCUCAC | 604 |
| RAB11FIP1 3' UTR Site 01 | UGGGACCACUGUAAACUUCUCAG | 605 |
| RAB11FIP1 3' UTR Site 02 | UGUAAACCUACCCAGCUUCUCAG | 606 |
| RABI1FIP1 3' UTR Site 03 | AGACACAGGCAUGUGCUUCUCAG | 607 |
| RBJ 3' UTR Site 01 | GAAGAGAGGUUCGUACUUCUCAU | 608 |
| RBJ 3' UTR Site 02 | UUCUCAUAUAUUGAAUUCUCAAC | 609 |
| SERBP1 3' UTR Site 01 | AAAAAUCUUUUUUCACUUCUCAU | 610 |

TABLE 6-continued

Target sequences

| Name | Sequence | SEQ ID NO |
|---|---|---|
| SERBP1 3' UTR Site 02 | CUACUCAAAACACAA CUUCUCAG | 611 |
| CTBP1 3' UTR | GAGGCAGUUGGCAAA CUUCUCAG | 612 |
| CRKL 3' UTR | AUGGAAAGGGUCUUC CUUCUCAU | 613 |
| ITGA3 3' UTR | UUCUUUGUAUAUAGG CUUCUCAC | 614 |
| 1TGAV 3' UTR | UGUUUUUGUCAUUG UUCUCAAG | 615 |
| LAMC1 3' UTR | GAGUUUCCUAGUGGG CUUCUCAA | 616 |
| G6PC2 3' UTR | AUGUUUUAUGUAACU CUUCUCAG | 617 |
| PPP2R5E 3' UTR | UGGACAGUAGAUGGA CUUCUCAG | 618 |
| KLF17 3' UTR | GUCAGGGAAGAAAGA CUUCUCAA | 619 |
| MTDH 3' UTR site 01 | UUAACAACAGUGCCC UGUUUACA | 621 |
| MTDH 3' UTR site 02 | AGGAACAUGGCAGUA UGUUUAC | 622 |
| MTDH 3' UTR site 03 | AACUGUCAUGGUUUA GUUUACAA | 623 |
| IGF1R 3' UTR site | UUUUUUUUUUUUUU UAGGACACCUGUUUA CU | 832 |
| MET 3' UTR site | AAAGUGUUAUAUUUU UUAUAAAAAUGUUUA UU | 833 |
| IRS1 3' UTR site | UGGUACGAUGCAUCC AUUUCAGUUUGUUUA CG | 834 |
| ACVR1 | ACUCAAGACUCCCAC UGUG | 950 |
| ASIC2 | CGGGCGGGCGCCCGC GGAGG | 951 |
| ATG14 | CAGCGAUGAAGAAAC CG | 952 |
| ATP 1A1 | GAGGCCUGCUUUUGA GAGGAA | 953 |
| B3GTNL1 | UGGAGACUGUUUGGA | 954 |
| BANF1 | ACUUCCGGCGCUGUC UCGG | 955 |
| BPTF | AUGAUUGUUCAGAAU A | 956 |
| CASP8AP2 | UGGAUGAUUGUUCAA AGA | 957 |
| CDX4 | AUCUGGUUUCAGAAU C | 958 |

TABLE 6-continued

Target sequences

| Name | Sequence | SEQ ID NO |
|---|---|---|
| CELF2 | AGGAUUCAGAUCUGU UUU | 959 |
| CHMP7 | GCCACCUGCCGCGCA GGCGCA | 960 |
| CKMT1B | ACUCAAGAUUCCCAG GAG | 961 |
| CLASP 1 site 01 | AUAGGAUUAGAUCGG UUU | 962 |
| CLASP 1 site 02 | CAGCCAGGAAGAAUA CCU | 963 |
| CNOT3 | UGGAAGAGGCCGCCU GGC | 964 |
| COL15A1 | CACGGAGGUCAGUUC AA | 965 |
| CYP3A4 | AACAGCCUGUGCUGG CUA | 966 |
| DBET Site 01 | AACACCUGGCUGGCU A | 967 |
| DBET Site 02 | ACGCGGGGUUGGGAC GGGGUCGGGU | 968 |
| DBET Site 03 | CAGGCGCAACCUCUC CUAGAAA | 969 |
| DBET Site 04 | CAUGAAGGGGUGGAG CCUG | 970 |
| DBET Site 05 | CCGGAAACAUGCAGG GAAG | 971 |
| DBET Site 06 | CCGGCUGGGAUUCC UGC | 972 |
| DBET Site 07 | CCGGGGAUCCCAGAG CCG | 973 |
| DBET Site 08 | CUCCUGGCUGCACCU GCCGCAGU | 974 |
| DBET Site 09 | CUGCCUCUCCACCAG CCCA | 975 |
| DBET Site 10 | CUGGGAUUCCUGCCU UCU | 976 |
| DBET Site 11 | GAAAUGAACGAGAGC CACA | 977 |
| DBET Site 12 | GCACCUGCCGCAGUG CACA | 978 |
| DBET Site 13 | GCCAUUCAUGAAGGG GUG | 979 |
| DBET Site 14 | GCCCCGGGGAGCUG GAG | 980 |
| DBET Site 15 | GCCUGCUGCUGGAUG A | 981 |
| DBET Site 16 | GGCACACUCAAGACU CCCACGGAG | 982 |
| DBET Site 17 | GGCACCCGGAAACAU GCAGGGAA | 983 |

TABLE 6 -continued

Target sequences

| Name | Sequence | SEQ ID NO |
|---|---|---|
| DBET Site 18 | GGCCGGUGAGAGACUCC | 984 |
| DBET Site 19 | GGCGGGAGGGAAGGCGGGCAGAGAU | 985 |
| DBET Site 20 | GGGCGUGUCUCCGCCCC | 986 |
| DBET Site 21 | UCCAGGCCGGUGAGAGACUC | 987 |
| DBET Site 22 | UCCCACGGAGGUUCAGUUCCA | 988 |
| DBET Site 23 | UCGGAAGAGGCGCCUCGC | 989 |
| DBET Site 24 | UGCGUUCCGCCGCCAGGCGCU | 990 |
| DBET site 25 | CAGCGAGGAAGAAUACCG | 991 |
| DCAF15 | GCCCCGGGGAGCCGGAG | 992 |
| DCN | GUCUUUGAGAGGAUCCCUUU | 993 |
| DLX5 | AUCUGGUUUCAGAAC | 994 |
| DUSP7 | GGGCCCUUCUUGAAGGGGUG | 995 |
| DUX1 | GAUGGCCCUCCUGACA | 996 |
| DUX4 Site 01 | AACACCUGGCUGGCUA | 997 |
| DUX4 Site 02 | ACCUGCGCGCAGUGCGCACCCCG | 998 |
| DUX4 Site 03 | ACCUUCCGACGCUGUCUAGG | 999 |
| DUX4 Site 04 | ACGCGGGGUUGGGACGGGGUCGGGU | 1000 |
| DUX4 Site 05 | AGCAGACCUGCGCGCAGUGCGCA | 1001 |
| DUX4 Site 06 | AGCUCGCUGGCCUCUCUG | 1002 |
| DUX4 Site 07 | AGUUCAGAGAUAUAUUAAAAUGCCC | 1003 |
| DUX4 Site 08 | AUCUGGUUUCAGAAUC | 1004 |
| DUX4 Site 09 | AUGAUUAGUUCAGAGAUA | 1005 |
| DUX4 Site 10 | AUGGCCCUCCCGACACCC | 1006 |
| DUX4 Site 11 | CAGACCUGCGCGCAGU | 1007 |
| DUX4 Site 12 | CAGGCGCAACCUCUCCUAGAAA | 1008 |
| DUX4 Site 13 | CCACCUUCCGACGCUG | 1009 |
| DUX4 Site 14 | CCGGCCUGGGAUUCCUGC | 1010 |
| DUX4 Site 15 | CCGGGGAUCCCAGAGCCG | 1011 |
| DUX4 Site 16 | CCUCCCUGUGGAUCCUAU | 1012 |
| DUX4 Site 17 | CCUGCCUCUCCACCAGCCC | 1013 |
| DUX4 Site 18 | CCUGCGCGCAGUGCGCACCCCGGCUGACGUGC | 1014 |
| DUX4 Site 19 | CCUGGAUGAUUAGUUC | 1015 |
| DUX4 Site 20 | CGACACCCUCGGACAGCA | 1016 |
| DUX4 Site 21 | CGGAGACUCGUUUGGA | 1017 |
| DUX4 Site 22 | CUGGAUUAGAGUUACAUCUCCUG | 1018 |
| DUX4 Site 23 | CUGGGAUUCCUGCCUUCU | 1019 |
| DUX4 Site 24 | CUGUGGAUCCUAUAG | 1020 |
| DUX4 Site 25 | CUUCCGACGCUGUCUA | 1021 |
| DUX4 Site 26 | GAGCCUGCUUUGAGCGGAA | 1022 |
| DUX4 Site 27 | GAGCCUUUGAGAAGGAUCGCUUU | 1023 |
| DUX4 Site 28 | GCCCCGGGGAGCUGGAG | 1024 |
| DUX4 Site 29 | GCCUGCUGCUGGAUGA | 1025 |
| DUX4 Site 30 | GGCCCGGUGAGAGACUCC | 1026 |
| DUX4 Site 31 | GGGAGCUCGCUGGCCUCU | 1027 |
| DUX4 Site 32 | GGGCGUGUCUCCGCCCC | 1028 |
| DUX4 Site 33 | GUCCAGGAUUCAGAUCUGGUUU | 1029 |
| DUX4 Site 34 | GUGGCAGGGCGCCCGCGCAGG | 1030 |
| DUX4 Site 35 | UACCAGCAGACCUGCGCGCAGU | 1031 |
| DUX4 Site 36 | UCCCUGUGGAUCCUAU | 1032 |

TABLE 6-continued

Target sequences

| Name | Sequence | SEQ ID NO |
|---|---|---|
| DUX4 Site 37 | UCGGAAGAGGCCGCCUCG | 1033 |
| DUX4 Site 38 | UCUAGGCCCGGUGAGAGACU | 1034 |
| DUX4 Site 39 | UGGAUGAUUAGUUCAGAG | 1035 |
| DUX4 site 40 | CAGCGAGGAAGAAUACCG | 1036 |
| DUX5 Site 01 | AUCUGGUUUCAGAAUC | 1037 |
| DUX5 Site 02 | GAUGGCCCUCCUGACA | 1038 |
| EMILIN1 | AUGGCCCCCGCACCCUC | 1039 |
| EPG5 | CUGUGGUUUCAGAAUC | 1040 |
| FAM13A | ACUUUGAAAAGGAUCUCUUU | 1041 |
| FBX03 | UGGAGAUUAGAUCAGAGUG | 1042 |
| FBXL22 | CCUGCGCGCACUGCGCCU | 1043 |
| FMNL3 | CAGAGGGGUGGAGCCUGU | 1044 |
| FREM2 | CAUAAAGGGGUGGAACCUGU | 1045 |
| FRMPD2 | CGGAGACUUUUGGA | 1046 |
| GADD45A | GUGGCAGGAGCAGCCCGC | 1047 |
| GID4 | CCACCCCGCGCGUGCGCGCCCCG | 1048 |
| GJD3 | UGAGGCGGCGGCGCAGUGCGCCCCG | 1049 |
| GMPR | CGCCGCCCCGCGCAGGCGCCCCGC | 1050 |
| GNAT1 | CUUCGACGCUGUCA | 1051 |
| GOSR1 | GCCAUUCAUGAUGGUGUG | 1052 |
| GPRC6A | AUGUUAGUUCAGAGAA | 1053 |
| HERC1 | CUGGCCUCUCCACCAGCCCUU | 1054 |
| HGF | AGGAUCAGAUCUGGUU | 1055 |
| HOOK3 | ACCACCAUGGCUGGUA | 1056 |
| HOXC9 | AUCUGGUUUCAGAAUC | 1057 |
| HSP40 Site 01 | GCCUACCGCCGCCAGGCGCU | 1058 |
| HSP40 Site 02 | GGUUUGAGUUACAUCUA | 1059 |
| HSP40 Site 03 | UGGAGUCAGAUCUGGUUU | 1060 |
| IRF9 Site 01 | CCUGGAAACAUGCAGGCAA | 1061 |
| IRF9 Site 02 | CGACAGCCUGGACAGCAAC | 1062 |
| IRF9 Site 03 | CUGGAAACAUGCAGGCAAG | 1063 |
| IRX5 | UCGGAGGGCCGCCUCGAC | 1064 |
| ITGA10 | UCUCCCUGUGGAUCCUCAU | 1065 |
| ITGA3 Site 01 | CACUGAGGUCCAGUUCCA | 1066 |
| ITGA9 | CUGUGGAAUCCUAUAA | 1067 |
| KCNC3 | GCCUGCUGCUGGAUGA | 1068 |
| KLHL3 | GCCUUUGCUGCUGGAUGA | 1069 |
| KLK6 | ACUCAAGAAUCCCCGGAG | 1070 |
| LARP6 | ACCUUCCUACGUGCUAGG | 1071 |
| MALT1 | CAGUUGCCUAGACCUGGAGCAGU | 1072 |
| MAP3K4 | ACUCAAGCCCCACGGAG | 1073 |
| MAPK10 | CACAGAGAUAUUUAAAAUUCUU | 1074 |
| MIR4661 | CUGUGGAUCCUGACAGA | 1075 |
| MIR8078 Site 01 | GGCCCGGUGAGAGACUCC | 1076 |
| MIR8078 Site 02 | UCUAGGCCCGGUGAGAGACU | 1077 |
| MTSS1 | UUUGAGAAGGAUGUUUU | 1078 |
| NDUFAF6 | CUCACCUCUCCUAGAAA | 1079 |
| NEBL | AAGAUGCAGAUCUGGUUU | 1080 |
| NKX2-3 | GGUAGGGACGGGCGGGU | 1081 |
| NR2F1 | CAGCGAGGAAGAAUGCCU | 1082 |

TABLE 6-continued

Target sequences

| Name | Sequence | SEQ ID NO |
|---|---|---|
| PC1D2 | GCCAUUCAUGAGGGGUC | 1083 |
| PDE10A | CUGACCUGCCGCAGU | 1084 |
| PKD1L2 | AACAGAGAUAUAUGUAAAAUUGCCA | 1085 |
| PKHD1 | GUCCAGGACUCACAGCUGGUUU | 1086 |
| PPP1R12B | GGAGGGAAGCGGGCAGAGU | 1087 |
| PTPRN2 | CAGAAGGGGGGAGCCUG | 1088 |
| PYY | CAGCAGACCUGCGCGCAGU | 1089 |
| RABGAP1L | GGAGAUAGAGUUACAUCUU | 1090 |
| rbck1 | CCUGCGCCCAGUGCGGACCU | 1091 |
| RFX3 | UACCUUCGACACUGUCAGG | 1092 |
| RHBDF2 | UGGCUUCCGCCGCCAGGCCU | 1093 |
| SCR1B | CUUCCAGACCUGUCUA | 1094 |
| SEMA3B | UGGGACGGGUCGCGU | 1095 |
| SETD4 | GAAAUGUACCAGAGCCACA | 1096 |
| SHFL | GGCUGAGCCGCGCAGUGCGGACCCUCGC | 1097 |
| SHH | GGGGGCGCCCGCGCAGG | 1098 |
| SLC37A4 | AUGAUUAUUUAGAGAUA | 1099 |
| SLC9A8 | GGCUGGGAGGGGAAGGCGGGUCAGAGAU | 1100 |
| SMAD1 | GGAUUGAGAUACAUCUG | 1101 |
| SPEF1 | AGAUCGCGCAGUGCGCCCCAG | 1102 |
| SPRED3 | CCUGCGCGCGUGCCAC | 1103 |
| ST3GAL6 | GUGGCAGGCGCCGC | 1104 |
| STAG1 | GGUUUAGAGUUACAUUCU | 1105 |
| SUPV3L1 Site 01 | CUGUGGAUCCUAUAA | 1106 |
| SUPV3L1 Site 02 | GGCCUGUGGAUCCUAU | 1107 |
| TBC1D26 | AUGGCCUUCCUGACACCC | 1108 |
| TCEA2 | UCUGGGCCGGGUGAGAGAC | 1109 |
| TCF3 | CUGGCUGCCCUGCGUGCAGU | 1110 |
| TM6SFI | GGCUGGUUUCAGAAUC | 1111 |
| TMEM108 | CUGAGACUCGUUGGA | 1112 |
| TMEM259 | GCCUGCUGCUGGAUGA | 1113 |
| TNFSF4 | CAGGAAGGGUGGAGCCUGC | 1114 |
| TNIP1 | GCGGCAAGGCGCCGCGCAGG | 1115 |
| TRNP1 | GAGGCCUGUUUGAGGGAA | 1116 |
| USH1G | CAUCCAGGGGUGGAGCCUG | 1117 |
| WRNIP1 | ACCUUCAGACGUGUCUGAGG | 1118 |
| XIAP | AGAUUAGAGUUAAUCUCCC | 1119 |
| ZNF574 | UUGCCUCUCCAGCAGCCCU | 1120 |

A condition or a disease, as disclosed herein, can include a cancer, a neurological disorder, a fibrosis disease, a scarring disease, or an autoimmune disease.

In some cases, a disease or condition may comprise a neurological disorder. In some cases, a neurological disorder may comprise Acquired Epileptiform Aphasia, Acute Disseminated Encephalomyelitis, Adrenoleukodystrophy, Agenesis of the corpus callosum, Agnosia, Aicardi syndrome, Alexander disease, Alpers' disease, Alternating hemiplegia, Alzheimer's disease, Amyotrophic lateral sclerosis (see Motor Neuron Disease), Anencephaly, Angelman syndrome, Angiomatosis, Anoxia, Aphasia, Apraxia, Arachnoid cysts, Arachnoiditis, Arnold-Chiari malformation, Arteriovenous mal-formation, Asperger's syndrome, Ataxia Telangiectasia, Attention Deficit Hyperactivity Disorder, Autism, Auditory processing disorder, Autonomic Dysfunction, Back Pain, Batten disease, Bechet's disease, Bell's palsy, Benign Essential Blepharospasm, Benign Focal Amyotrophy, Benign Intracranial Hypertension, Bilateral frontoparietal polymicrogyria, Binswanger's disease, Blepharo-spasm, Bloch-Sulzberger syndrome, Brachial plexus injury, Brain abscess, Brain damage, Brain in-jury, Brain tumor, Brown-Sequard syndrome, Canavan disease, Carpal tunnel syndrome (CTS), Causalgia, Central pain syndrome, Central pontine myelinolysis, Centronuclear myopathy, Cephalic disorder, Cerebral aneurysm, Cerebral arteriosclerosis, Cerebral atrophy, Cerebral gigantism, Cerebral palsy, Charcot-Marie-Tooth disease, Chiari malformation, Chorea, Chronic inflammatory demyelinating polyneuropathy (CIDP), Chronic pain, Chronic regional pain syndrome, Coffin Lowry syndrome, Coma, including Persistent Vegetative State, Congenital facial diplegia, Corticobasal degeneration, Cranial arteritis, Craniosynostosis, Creutzfeldt-Jakob disease, Cumulative trauma disorders, Cushing's syndrome, Cytomegalic inclusion body disease (CIBD), Cytomegalovirus Infection, Dandy-Walker syndrome, Dawson disease, De Morsier's syndrome, Dejerine-Klumpke palsy, Dejerine-Sottas disease, Delayed sleep phase syndrome, Dementia, Dermatomyositis, Neurological Dyspraxia, Diabetic neuropathy, Diffuse sclerosis, Dysautonomia, Dyscalculia, Dysgraphia, Dyslexia, Dystonia, Early infantile epileptic encephalopathy, Empty sella syndrome, Encephalitis, Encephalocele, Encephalotrigeminal angiomatosis, Encopresis, Epilepsy, Erb's palsy, Erythromelalgia, Essential tremor, Fabry's disease, Fahr's syndrome, Fainting, Familial spastic paralysis, Febrile seizures, Fisher syndrome, Friedreich's ataxia, FART Syndrome, Gaucher's disease, Gerstmann's syndrome, Giant cell arteritis, Giant cell inclusion disease, Globoid cell Leukodystrophy, Gray matter heterotopia, Guillain-Barre syndrome, HTLV-1 associated myelopathy, Hallervorden-Spatz disease, Head injury, Headache, Hemifacial Spasm, Hereditary Spastic Paraplegia, Heredopathia atactica polyneuritiformis, Herpes zoster oticus, Herpes zoster, Hirayama syndrome, Holoprosencephaly, Huntington's disease, Hydranencephaly, Hydrocephalus, Hypercortisolism, Hypoxia, Immune-Mediated encephalomyelitis, Inclusion body myositis, Incontinentia pigmenti, Infantile phytanic acid storage disease, Infantile Refsum disease, Infantile spasms, Inflammatory myopathy, Intracranial cyst, Intracranial hypertension, Joubert syndrome, Kearns-Sayre syndrome, Kennedy disease, Kinsbourne syndrome, Klippel Feil syndrome, Krabbe disease, Kugelberg-Welander disease, Kuru, Lafora disease, Lambert-Eaton myasthenic syndrome, Landau-Kleffner syndrome, Lateral medullary (Wallenberg) syndrome, Learning disabilities, Leigh's disease, Lennox-Gastaut syndrome, Lesch-Nyhan syndrome, Leukodystrophy, Lewy body dementia, Lissencephaly, Locked-In syn-drome, Lou Gehrig's disease, Lumbar disc disease, Lyme disease—Neurological Sequelae, Macha-do-Joseph disease (Spinocerebellar ataxia type 3), Macrencephaly, Maple Syrup Urine Disease, Megalencephaly, Melkersson-Rosenthal syndrome, Menieres disease, Meningitis, Menkes disease, Metachromatic leukodystrophy, Microcephaly, Migraine, Miller Fisher syndrome, Mini-Strokes, Mitochondrial Myopathies, Mobius syndrome, Monomelic amyotrophy, Motor Neuron Disease, Motor skills disorder, Moyamoya disease, Mucopolysaccharidoses, Multi-Infarct Dementia, Multi-focal motor neuropathy, Multiple sclerosis, Multiple system atrophy, Muscular dystrophy, Myalgic encephalomyelitis, Myasthenia gravis, Myeloclastic diffuse sclerosis, Myoclonic Encephalopathy of infants, Myoclonus, Myopathy, Myotubular myopathy, Myotonia congenita, Narcolepsy, Neuro-fibromatosis, Neuroleptic malignant syndrome, Neurological manifestations of AIDS, Neurological sequelae of lupus, Neuromyotonia, Neuronal ceroid lipofuscinosis, Neuronal migration disorders, Niemann-Pick disease, Non 24-hour sleep-wake syndrome, Nonverbal learning disorder, O'Sulli-van-McLeod syndrome, Occipital Neuralgia, Occult Spinal Dysraphism Sequence, Ohtahara syndrome, Olivopontocerebellar atrophy, Opsoclonus myoclonus syndrome, Optic neuritis, Orthostatic Hypotension, Overuse syndrome, Palinopsia, Paresthesia, Parkinson's disease, Paramyotonia Con-genita, Paraneoplastic diseases, Paroxysmal attacks, Parry-Romberg syndrome, Rombergs Syndrome, Pelizaeus-Merzbacher disease, Periodic Paralyses, Peripheral neuropathy, Persistent Vegetative State, Pervasive neurological disorders, Photic sneeze reflex, Phytanic Acid Storage disease, Pick's disease, Pinched Nerve, Pituitary Tumors, PMG, Polio, Polymicrogyria, Polymyositis, Porencephaly, Post-Polio syndrome, Postherpetic Neuralgia (PHN), Postinfectious Encephalomyelitis, Postural Hypotension, Prader-Willi syndrome, Primary Lateral Sclerosis, Prion diseases, Progressive Hemifacial Atrophy also known as Rombergs Syndrome, Progressive multifocal leukoencephalopathy, Progressive Sclerosing Poliodystrophy, Progressive Supranuclear Palsy, Pseudotumor cerebri, Ramsay-Hunt syndrome (Type I and Type II), Rasmussen's encephalitis, Reflex sympathetic dystrophy syndrome, Refsum disease, Repetitive motion disorders, Repetitive stress injury, Restless legs syndrome, Retrovirus-associated myelopathy, Rett syndrome, Reye's syndrome, Rombergs Syndrome, Rabies, Saint Vitus dance, Sandhoff disease, Schytsophrenia, Schilder's disease, Schizencephaly, Sensory Integration Dysfunction, Septooptic dysplasia, Shaken baby syndrome, Shingles, Shy-Drager syndrome, Sjogren's syndrome, Sleep apnea, Sleeping sickness, Snatiation, Sotos syndrome, Spasticity, Spina bifida, Spinal cord injury, Spinal cord tumors, Spinal muscular atrophy, Spinal stenosis, Steele-Richardson-Olszewski syndrome, see Progressive Supranuclear Palsy, Spinocerebellar ataxia, Stiff-person syndrome, Stroke, Sturge-Weber syndrome, Subacute sclerosing panencephalitis, Subcortical arteriosclerotic encephalopathy, Superficial siderosis, Syden-ham's chorea, Syncope, Synesthesia, Syringomyelia, Tardive dyskinesia, Tay-Sachs disease, Temporal arteritis, Tethered spinal cord syndrome, Thomsen disease, Thoracic outlet syndrome, Tic Douloureux, Todd's paralysis, Tourette syndrome, Transient ischemic attack, Transmissible spongiform encephalopathies, Transverse myelitis, Traumatic brain injury, Tremor, Trigeminal neuralgia, Tropical spastic paraparesis, Trypanosomiasis, Tuberous sclerosis, Vasculitis including temporal arteritis, Von Hippel-Lindau disease (VHL), Viliuisk Encephalomyelitis (VE), Wallenberg's syn-drome, Werdnig-Hoffman disease, West syndrome, Whiplash, Williams syndrome, Wilson's dis-ease, X-Linked Spinal and Bulbar Muscular Atrophy, and Zellweger syndrome. Neurological conditions can comprise movement disorders, for example multiple system atrophy (MSA).

In some cases, a disease or condition may comprise an autoimmune disease. In some cases, an autoimmune disease may comprise acute disseminated encephalomyelitis (ADEM), acute necrotizing hemorrhagic leukoencephalitis, Addison's disease, agammaglobulinemia, allergic asthma, allergic rhinitis, alopecia areata, amyloidosis, ankylosing spondylitis, anti-GBM/anti-TBM nephritis, antiphospholipid syndrome (APS), autoimmune aplastic anemia, autoimmune dysautonomia, autoimmune hepatitis, autoimmune hyperlipidemia, autoimmune immunodeficiency, autoimmune inner ear disease (AIED), autoimmune myocarditis, autoimmune pancreatitis, autoimmune retinopathy, autoimmune thrombocytopenic purpura (ATP), autoimmune thyroid disease, axonal & neuronal neuropathies, Balo disease, Bechet's disease, bullous pemphigoid, cardiomyopathy, Castlemen disease, celiac sprue (non-tropical), Chagas disease, chronic fatigue syndrome, chronic inflammatory demyelinating polyneuropathy (CIDP), chronic recurrent multifocal ostomyelitis (CRMO), Churg-Strauss syndrome, cicatricial pemphigoid/benign mucosal pemphigoid, Crohn's disease, Cogan's syndrome, cold agglutinin disease, congenital heart block, coxsackie myocarditis, CREST disease, essential mixed cryoglobulinemia, demyelinating neuropathies, dermatomyositis, Devic's disease (neuromyelitis optica), discoid lupus, Dressler's syndrome, endometriosis, eosinophillic fasciitis, erythema nodosum, experimental allergic encephalomyelitis, Evan's syndrome, fibromyalgia, fibrosing alveolitis, giant cell arteritis (temporal arteritis), glomerulonephritis, Goodpasture's syn-drome, Grave's disease, Guillain-Barre syndrome, Hashimoto's encephalitis, Hashimoto's thyroiditis, hemolytic anemia, Henock-Schoniein purpura, herpes gestationis, hypogammaglobulinemia, idiopathic thrombocytopenic purpura (ITP), IgA nephropathy, immunoregulatory lipoproteins, inclusion body myositis, insulin-dependent diabetes (type 1), interstitial cystitis, juvenile arthritis, juvenile diabetes, Kawasaki syndrome, Lambert-Eaton syndrome, leukocytoclastic vasculitis, lichen planus, lichen sclerosis, ligneous conjunctivitis, linear IgA disease (LAD), Lupus (SLE), Lyme dis-ease, Meniere's disease, microscopic polvangitis, mixed connective tissue disease (MCTD), Mooren's ulcer, Mucha-Habermann disease, multiple sclerosis, myasthenia gravis, myositis, narcolepsy, neuromyelitis optica (Devic's), neutropenia, ocular cicatricial pemphigoid, optic neuritis, palindromic rheumatism, PANDAS (Pediatric Autoimmune Neuropsychiatric Disorders Associated with *Streptococcus*), paraneoplastic cerebellar degeneration, paroxysmal nocturnal hemoglobinuria (PNH), Parry Romberg syndrome, Parsonnage-Turner syndrome, pars plantis (peripheral uveitis), pemphigus, peripheral neuropathy, perivenous encephalomyelitis, pernicious anemia, POEMS syn-drome, polyarteritis nodosa, type I, II & III autoimmune polyglandular syndromes, polymyalgia rheumatic, polymyositis, postmyocardial infarction syndrome, postpericardiotomy syndrome, progesterone dermatitis, primary biliary cirrhosis, primary sclerosing cholangitis, psoriasis, psoriatic arthritis, idiopathic pulmonary fibrosis, pyoderma gangrenosum, pure red cell aplasis, Raynaud's phenomena, reflex sympathetic dystrophy, Reiter's syndrome, relapsing polychondritis, restless legs syndrome, retroperitoneal fibrosis, rheumatic fever, rheumatoid arthritis, sarcoidosis, Schmidt syn-drome, scleritis, scleroderma, Slogren's syndrome, sperm and testicular autoimmunity, stiff person syndrome, subacute bacterial endocarditis (SBE), sympathetic ophthalmia, Takayasu's arteritis, temporal arteritis/giant cell arteries, thrombocytopenic purpura (TPP), Tolosa-Hunt syndrome, transverse myelitis, ulcerative colitis, undifferentiated connective tissue disease (UCTD), uveitis, vasculitis, vesiculobullous dermatosis, vitiligo or Wegener's granulomatosis or, chronic active hepatitis, primary biliary cirrhosis, cadilated cardiomyopathy, myocarditis, autoimmune polyendocrine syn-drome type I (APS-I), cystic fibrosis vasculitides, acquired hypoparathyroidism, coronary artery disease, pemphigus foliaceus, pemphigus vulgaris, Rasmussen encephalitis, autoimmune gastritis, insulin hypoglycemic syndrome (Hirata disease), Type B insulin resistance, acanthosis, systemic lupus erythematosus (SLE), pernicious anemia, treatment-resistant Lyme arthritis, polyneuropathy, demyelinating diseases, atopic dermatitis, autoimmune hypothyroidism, vitiligo, thyroid associated ophthalmopathy, autoimmune coeliac disease, ACTH deficiency, dermatomyositis, Sjogren syndrome, systemic sclerosis, progressive systemic sclerosis, morphea, primary antiphospholipid syndrome, chronic idiopathic urticaria, connective tissue syndromes, necrotizing and crescentic glomerulonephritis (NCGN), systemic vasculitis, Raynaud syndrome, chronic liver disease, visceral leishmaniasis, autoimmune C1 deficiency, membrane proliferative glomerulonephritis (MPGN), prolonged coagulation time, immunodeficiency, atherosclerosis, neuronopathy, paraneoplastic pemphigus, paraneoplastic stiff man syn-drome, paraneoplastic encephalomyelitis, subacute autonomic neuropathy, cancer-associated retinopathy, paraneoplastic opsoclonus myoclonus ataxia, lower motor neuron syndrome and Lambert-Eaton myasthenic syndrome.

In some cases, a disease or a condition may comprise AIDS, anthrax, botulism, brucellosis, chancroid, chlamydial infection, cholera, coccidioidomycosis, cryptosporidiosis, cyclosporiasis, dipheheria, ehrlichiosis, arboviral encephalitis, enterohemorrhagic *Escherichia coli*, giardiasis, gonorrhea, dengue fever, *Haemophilus* influenza, Hansen's disease (Leprosy), hantavirus pulmonary syn-drome, hemolytic uremic syndrome, hepatitis A, hepatitis B, hepatitis C, human immunodeficiency virus, legionellosis, listeriosis, Lyme disease, malaria, measles. Meningococcal disease, mumps, pertussis (whooping cough), plague, paralytic poliomyelitis, psittacosis, Q fever, rabies, rocky mountain spotted fever, rubella, congenital rubella syndrome, shigellosis, smallpox, streptococcal disease (invasive group A), streptococcal toxic shock syndrome, *Streptococcus pneumonia*, syphilis, tetanus, toxic shock syndrome, trichinosis, tuberculosis, tularemia, typhoid fever, vancomycin intermediate resistant *Staphylocossus aureus*, varicella, yellow fever, variant Creutzfeldt-Jakob dis-ease (vCJD), Ebola hemorrhagic fever, Echinococcosis, Hendra virus infection, human monkey-pox, influenza A, influenza B, H5N1, lassa fever, Margurg hemorrhagic fever, Nipah virus, O'nyong fever, Rift valley fever, Herpes, HIV, HCV genotype 1, HCV genotype 2, HCV genotype 3, HCV genotype 4, HCV genotype 5, HCV genotype 6, SARS-CoV-2 (COVID-19), SARS-CoV (SARS), MERS-CoV (MERS), 229E coronavirus, NL63 coronavirus, OC43 coronavirus, CoV-HKU1 (HKU1), alpha coronavirus, beta coronavirus, Venezuelan equine encephalitis and West Nile virus.

In some cases, a disease or condition may comprise a fibrosis disease, a scarring disease or both. In some cases, a fibrosis disease or a scarring disease may comprise, pulmonary fibrosis, cystic fibrosis, idiopathic pulmonary fibrosis, radiation induced fibrosis, myocardial fibrosis, bridging fibrosis, cirrhosis, gliosis, arterial stiffness, arthrofibrosis, Chron's disease, Dupuytren's contracture, keloid, mediastinal fibrosis, myelofibrosis, Peyronie's disease, nephrogenic systemic fibrosis, progressive massive fibrosis, retroperitoneal fibrosis, scleroderma/systemic sclerosis, and adhesive capsulitis.

In some cases, a disease or condition may comprise a cancer. In some cases, a cancer may comprise thyroid cancer, adrenal cortical cancer, anal cancer, aplastic anemia, bile duct cancer, bladder cancer, bone cancer, bone metastasis, central nervous system (CNS) cancers, peripheral nervous system (PNS) cancers, breast cancer, Castleman's disease, cervical cancer, childhood Non-Hodgkin's lymphoma, lymphoma, colon and rectum cancer, endometrial cancer, esophagus cancer, Ewing's family of tumors (e.g. Ewing's sarcoma), eye cancer, gallbladder cancer, gastrointestinal carcinoid tumors, gastrointestinal stromal tumors, gestational trophoblastic disease, hairy cell leukemia, Hodgkin's disease, Kaposi's sarcoma, kidney cancer, laryngeal and hypopharyngeal cancer, acute lymphocytic leukemia, acute myeloid leukemia, children's leukemia, chronic lymphocytic leukemia, chronic myeloid leukemia, liver cancer, lung cancer, lung carcinoid tumors, Non-Hodgkin's lymphoma, male breast cancer, malignant mesothelioma, multiple myeloma, myelodysplastic syndrome, myeloproliferative disorders, nasal cavity and paranasal cancer, nasopharyngeal cancer, neuroblastoma, oral cavity and oropharyngeal cancer, osteosarcoma, ovarian cancer, pancreatic cancer, penile cancer, pituitary tumor, prostate cancer, retinoblastoma, rhabdomyosarcoma, salivary gland cancer, sarcoma (adult soft tissue cancer), melanoma skin cancer, non-melanoma skin cancer, stomach cancer, testicular cancer, thymus cancer, uterine cancer (e.g. uterine sarcoma), vaginal cancer, vulvar cancer, or Waldenstrom's macroglobulinemia. In some cases, a cancer may be selected from a list maintained by the National Cancer Institute (https://www.cancer.gov/types).

A condition or a disease, as disclosed herein, can include hyperproliferative disorders. Malignant hyperproliferative disorders can be stratified into risk groups, such as a low risk group and a medium-to-high risk group. Hyperproliferative disorders can include but may not be limited to cancers, hyperplasia, or neoplasia. In some cases, the hyperproliferative cancer can be breast cancer such as a ductal carcinoma in duct tissue of a mammary gland, medullary carcinomas, colloid carcinomas, tubular carcinomas, and inflammatory breast cancer; ovarian cancer, including epithelial ovarian tumors such as adenocarcinoma in the ovary and an adenocarcinoma that has migrated from the ovary into the abdominal cavity; uterine cancer; cervical cancer such as adenocarcinoma in the cervix epithelial including squamous cell carcinoma and adenocarcinomas; prostate cancer, such as a prostate cancer selected from the following: an adenocarcinoma or an adenocarcinoma that has mi-grated to the bone; pancreatic cancer such as epithelioid carcinoma in the pancreatic duct tissue and an adenocarcinoma in a pancreatic duct; bladder cancer such as a transitional cell carcinoma in urinary bladder, urothelial carcinomas (transitional cell carcinomas), tumors in the urothelial cells that line the bladder, squamous cell carcinomas, adenocarcinomas, and small cell cancers; leukemia such as acute myeloid leukemia (AML), acute lymphocytic leukemia, chronic lymphocytic leukemia, chronic myeloid leukemia, hairy cell leukemia, myelodysplasia, myeloproliferative disorders, acute myelogenous leukemia (AML), chronic myelogenous leukemia (CML), mastocytosis, chronic lymphocytic leukemia (CLL), multiple myeloma (MM), and myelodysplastic syndrome (MDS); bone cancer; lung cancer such as non-small cell lung cancer (NSCLC), which may be divided into squamous cell carcinomas, adenocarcinomas, and large cell undifferentiated carcinomas, and small cell lung cancer; skin cancer such as basal cell carcinoma, melanoma, squamous cell carcinoma and actinic keratosis, which may be a skin condition that sometimes develops into squamous cell carcinoma; eye retinoblastoma; cutaneous or intraocular (eye) melanoma; primary liver cancer (cancer that begins in the liver); kidney cancer; autoimmune deficiency syndrome (AIDS)-related lympho-ma such as diffuse large B-cell lymphoma, B-cell immunoblastic lymphoma and small non-cleaved cell lymphoma; Kaposi's Sarcoma; viral-induced cancers including hepatitis B virus (HBV), hepatitis C virus (HCV), and hepatocellular carcinoma; human lymphotropic virus-type 1 (HTLV-1) and adult T-cell leukemia/lymphoma; and human papilloma virus (HPV) and cervical cancer; central nervous system (CNS) cancers such as primary brain tumor, which includes gliomas (astrocytoma, anaplastic astrocytoma, or glioblastoma multiforme), oligodendrogliomas, ependymomas, meningiomas, lymphomas, schwannomas, and medulloblastomas; peripheral nervous system (PNS) cancers such as acoustic neuromas and malignant peripheral nerve sheath tumors (MPNST) including neurofibromas and schwannomas, malignant fibrous cytomas, malignant fibrous histiocytomas, malignant meningiomas, malignant mesotheliomas, and malignant mixed Müllerian tumors; oral cavity and oropharyngeal cancer such as hypopharyngeal cancer, laryngeal cancer, nasopharyngeal cancer, and oropharyngeal cancer; stomach cancer such as lymphomas, gastric stromal tumors, and carcinoid tumors; testicular cancer such as germ cell tumors (GCTs), which include seminomas and nonseminomas, and gonadal stromal tumors, which include Leydig cell tumors and Sertoli cell tumors; thymus cancer such as to thymomas, thymic carcinomas, Hodgkin disease, non-Hodgkin lymphomas carcinoids or carcinoid tumors; rectal cancer; and colon cancer. In some cases, the dis-eases stratified, classified, characterized, or diagnosed by the methods of the present disclosure include but may not be limited to thyroid disorders such as for example benign thyroid disorders including but not limited to follicular adenomas, Hurthle cell adenomas, lymphocytic thyroiditis, and thyroid hyperplasia. In some cases, the diseases stratified, classified, characterized, or diagnosed by the methods of the present disclosure include but may not be limited to malignant thyroid disorders such as for example follicular carcinomas, follicular variant of papillary thyroid carcinomas, medullary carcinomas, and papillary carcinomas.

Conditions or diseases of the present disclosure can include a genetic disorder. A genetic disorder may be an illness caused by abnormalities in genes or chromosomes. Genetic disorders can be grouped into two categories: single gene disorders and multifactorial and polygenic (complex) dis-orders. A single gene disorder can be the result of a single mutated gene. Inheriting a single gene disorder can include but not be limited to autosomal dominant, autosomal recessive, X-linked dominant, X-linked recessive, Y-linked and mitochondrial inheritance. In some cases, one mutated copy of the gene can be necessary for a person to be affected by an autosomal dominant disorder. Examples of autosomal dominant type of disorder can include but are not limited to Huntington's disease, Neurofibromatosis 1, Marfan Syndrome, Hereditary nonpolyposis colorectal cancer, or Hereditary multiple exostoses. In autosomal recessive disorders, two copies of the gene can be mutated for a subject to be affected by an autosomal recessive disorder. Examples of this type of disorder can include but may not be limited to cystic fibrosis, sickle-cell disease (also partial sickle-cell disease), Tay-Sachs disease, Niemann-Pick disease, or spinal muscular atrophy. X-linked dominant disorders are caused by mutations in genes on the X chromosome such as X-linked hypophosphatemic rickets. Some X-linked dominant conditions such as Rett syndrome, Incontinentia Pigmenti type 2 and Aicardi Syndrome can be fatal. X-linked recessive disorders are also caused by mutations in genes on the X chromosome. Examples of this type of disorder can include but are not limited to Hemophilia A, Duchenne muscular dystrophy, red-green color blindness, muscular dystrophy and Androgenetic alopecia. Y-linked disorders are caused by mutations on the Y chromo-some. Examples can include but are not limited to Male Infertility and hypertrichosis pinnae. The genetic disorder of mitochondrial inheritance, also known as maternal inheritance, can apply to genes in mitochondrial DNA such as in Leber's Hereditary Optic Neuropathy.

Genetic disorders may also be complex, multifactorial or polygenic. Polygenic genetic disorders can be associated with the effects of multiple genes in combination with lifestyle and environmental factors. Although complex genetic disorders can cluster in families, they do not have a clear-cut pattern of inheritance. Multifactorial or polygenic disorders can include heart disease, diabetes, asthma, autism, autoimmune diseases such as multiple sclerosis, cancers, ciliopathies, cleft palate, hypertension, inflammatory bowel disease, mental retardation or obesity.

Other genetic disorders can include but may not be limited to 1p36 deletion syndrome, 21-hydroxylase deficiency, 22q11.2 deletion syndrome, aceruloplasminemia, achondrogenesis, type II, achondroplasia, acute intermittent *Porphyria*, adenylosuccinate lyase deficiency, Adrenoleukodystrophy, Alexander disease, alkaptonuria, alpha-1 antitrypsin deficiency, Alstrom syndrome, Alzheimer's disease (type 1, 2, 3, and 4), Amelogenesis Imperfecta, amyotrophic lateral sclerosis, Amyotrophic lateral sclerosis type 2, Amyotrophic lateral sclerosis type 4, amyotrophic lateral sclerosis type 4, androgen insensitivity syndrome, Anemia, Angelman syndrome, Apert syndrome, ataxia-telangiectasia, Beare-Stevenson cutis gyrata syndrome, Benjamin syndrome, beta thalassemia, biotimidase deficiency, Birt-Hogg-Dube syndrome, bladder cancer, Bloom syndrome, Bone diseases, breast cancer, Camptomelic dysplasia, Canavan disease, Cancer, Celiac Disease, Chronic Granulomatous Disorder (CGD), Charcot-Marie-Tooth disease, Charcot-Marie-Tooth disease Type 1, Charcot-Marie-Tooth disease Type 4, Charcot-Marie-Tooth disease Type 2, Charcot-Marie-Tooth disease Type 4, Cockayne syndrome, Coffin-Lowry syndrome, collagenopathy types II and XI, Colorectal Cancer, Congenital absence of the vas deferens, congenital bilateral absence of vas deferens, congenital diabetes, congenital erythropoietic *Porphyria*, Congenital heart disease, congenital hypothyroidism, Connective tissue disease, Cowden syndrome, Cri du chat syndrome, Crohn's dis-ease, fibrostenosing, Crouzon syndrome, Crouzonodermoskeletal syndrome, cystic fibrosis, De Grouchy Syndrome, Degenerative nerve diseases, Dent's disease, developmental disabilities, Di-George syndrome, Distal spinal muscular atrophy type V, Down syndrome, Dwarfism, Ehlers-Danlos syndrome, Ehlers-Danlos syndrome arthrochalasia type, Ehlers-Danlos syndrome classical type, Ehlers-Danlos syndrome dermatosparaxis type, Ehlers-Danlos syndrome kyphoscoliosis type, vascular type, erythropoietic protoporphyria, Fabry's disease, Facial injuries and disorders, factor V Leiden thrombophilia, familial adenomatous polyposis, familial dysautonomia, fanconi anemia, FG syndrome, fragile X syndrome, Friedreich ataxia, Friedreich's ataxia, G6PD deficiency, galactosemia, Gaucher's disease (type 1, 2, and 3), Genetic brain disorders, Glycine encephalopathy, Haemochromatosis type 2, Haemochromatosis type 4, Harlequin Ichthyosis, Head and brain malformations, Hearing disorders and deafness, Hearing problems in children, hemochromatosis (neonatal, type 2 and type 3), hemophilia, hepatoerythropoietic *Porphyria*, hereditary coproporphyria, Hereditary Multiple Exostoses, hereditary neuropathy with liability to pressure palsies, hereditary non-polyposis colorectal cancer, homocystinuria, Huntington's disease, Hutchinson Gilford Progeria Syndrome, hyperoxaluria, primary, hyperphenylalaninemia, hypochondrogenesis, hypochondroplasia, idic15, incontinentia pigmenti, Infantile Gaucher disease, infantile-onset ascending hereditary spastic paralysis, Infertility, Jackson-Weiss syndrome, Joubert syndrome, Juvenile Primary Lateral Sclerosis, Kennedy disease, Klinefelter syndrome, Kniest dysplasia, Krabbe disease, Learning disability, Lesch-Nyhan syndrome, Leukodystrophies, Li-Fraumeni syndrome, lipoprotein lipase deficiency, familial, Male genital disorders, Marfan syndrome, McCune-Albright syndrome, McLeod syndrome, Mediterranean fever, familial, Menkes disease, Menkes syndrome, Metabolic disorders, methemoglobinemia beta-globin type, Methemoglobinemia congenital methaemoglobinaemia, methylmalonic acidemia, Micro syndrome, Microcephaly, Movement disorders, Mowat-Wilson syndrome, Mucopolysaccharidosis (MPS I), Muenke syndrome, Muscular dystrophy, Muscular dystrophy, Duchenne and Becker type, muscular dystrophy, Duchenne and Becker types, myotonic dystrophy, Myotonic dystrophy type 1 and type 2, Neonatal hemochromatosis, neurofibromatosis, neurofibromatosis 1, neurofibromatosis 2, Neurofibromatosis type I, neurofibromatosis type II, Neurologic diseases, Neuromuscular disorders, Niemann-Pick disease, Nonketotic hyperglycinemia, nonsyndromic deafness, Nonsyndromic deafness autosomal recessive, Noonan syn-drome, osteogenesis imperfecta (type I and type III), otospondylomegaepiphyseal dysplasia, pantothenate kinase-associated neurodegeneration, Patau Syndrome (Trisomy 13), Pendred syndrome, Peutz-Jeghers syndrome, Pfeiffer syndrome, phenylketonuria, *Porphyria, Porphyria cutanea tarda*, Prader-Willi syndrome, primary pulmonary hypertension, prion disease, Progeria, propionic acidemia, protein C deficiency, protein S deficiency, pseudo-Gaucher disease, pseudoxanthoma elasticum, Retinal disorders, retinoblastoma, retinoblastoma FA-Friedreich ataxia, Rett syndrome, Rubinstein-Taybi syndrome, Sandhoff disease, sensory and autonomic neuropathy type III, sickle cell anemia, skeletal muscle regeneration, Skin pigmentation disorders, Smith Lemli Opitz Syn-drome, Speech and communication disorders, spinal muscular atrophy, spinal-bulbar muscular atrophy, spinocerebellar ataxia, spondyloepimetaphyseal dysplasia, Strudwick type, spondyloepiphyseal dysplasia congenita, Stickler syndrome, Stickler syndrome COL2A1, Tay-Sachs disease, tetrahydrobiopterin deficiency, thanatophoric dysplasia, thiamine-responsive megaloblastic anemia with diabetes mellitus and sensorineural deafness, Thyroid disease, Tourette's Syndrome, Treacher Collins syndrome, triple X syndrome, tuberous sclerosis, Turner syndrome, Usher syndrome, variegate *Porphyria*, von Hippel-Lindau disease, Waardenburg syndrome, Weissenbacher-Zweymüller syndrome, Wilson disease, Wolf-Hirschhorn syndrome, Xeroderma Pigmentosum, X-linked severe combined immunodeficiency, X-linked sideroblastic anemia, or X-linked spinal-bulbar muscle atrophy.

As used herein, a second therapy can include chemotherapy, radiation, bone marrow transplantation, immunotherapy, hormone therapy, cryotherapy, surgical procedure (such as tumor resection) or any combination thereof. A second therapy can include administration of a pharmaceutical composition, such as a small molecule. A second therapy can include administration of a pharmaceutical composition, such as one or more antiviral drugs, for example, interferon, oseltamivir, ribavirin, daclatasvir, sofosbuvir, velpatasvir, voxilapresvir, remdesivir, indomethacin, or any combination thereof. A second therapy can include administration of a pharmaceutical composition, such as one or more antibiotics. A second therapy can comprise administration of a muscle relaxant, an anti-depressant, a steroid, an opioid, a *cannabis*-based therapeutic, acetaminophen, a non-steroidal anti-inflammatory, a neuropathic agent, a *cannabis*, a progestin, a progesterone, or any combination thereof. A neuropathic agent may comprise gabapentin. A non-steroidal anti-inflammatory can comprise naproxen, ibuprofen, a COX-2 inhibitor, or any combination thereof. A second therapy can comprise administration of a biologic agent, cellular therapy, regenerative medicine therapy, a tissue engineering approach, a stem cell transplantation or any combination thereof. A second therapy can comprise a medical procedure. A medical procedure can comprise an epidural injection (such as a steroid injection), acupuncture, exercise, physical therapy, an ultrasound, a surgical therapy, a chiropractic manipulation, an osteopathic manipulation, a chemonucleolysis, or any combination thereof. A second therapy can comprise use of a breathing assist device or a ventilator. A second therapy can comprise administration of a regenerative therapy or an immunotherapy such as a protein, a stem cell, a cord blood cell, an umbilical cord tissue, a tissue, or any combination thereof. A second therapy can comprise a biosimilar.

The term "fragment," as used herein, can be a portion of a sequence, a subset that can be shorter than a full-length sequence. A fragment can be a portion of a gene. A fragment can be a portion of a peptide or protein. A fragment can be a portion of an amino acid sequence. A fragment can be a portion of an oligonucleotide sequence. A fragment can be less than about: 20, 30, 40, 50 amino acids in length. A fragment can be less than about: 2, 5, 10, 20, 30, 40, 50 oligonucleotides in length.

Compositions and methods as described herein include methods of identifying mutations or modifications to a guide strand that may improve therapeutic efficacy through improved knockdown (at least partially or completely) of one or more targets. Sequence modifications to a passenger strand are also described herein. Chemical modifications to one or more both strands are also described herein. Constructs or mimics as described herein may comprise one or more sequence alterations in a guide strand that may curb target recognition toward a preferred mRNA target among a plurality of mRNA targets. Such constructs or mimics may enhance stability, at least partially reduce or eliminate an immune stimulation, improve a pharmacological activity, retain one or more poly-targeting effect, or any combination thereof.

Compositions and methods as described herein can include miR mimics (such as miR-30, miR-29, miR-26, miR-27, miR-101, miR-145, miR-205, miR-338, and miR-375 mimics) having improved stability, safety, and/or activity as compared to a comparable miR (such as miR-30, miR-29, miR-26, miR-27, miR-101, miR-145, miR-205, miR-338, and miR-375).

Mimics can be identified using intelligent design, testing of one or more chemical modification patterns, sequence mutation in passenger strands that can improve mimic complementarity or alter mimic duplex structure, and sequence mutation to the guide strand that can yield benefits in activity. In some cases, a sequence mutation in the guide strand can move beyond use of natural guide sequence to use of mimics. For example, sequence alterations can tailor guide strand activity toward preferred downstream targets, such as clinical targets.

Because miRNAs are grouped in families based on sequence similarity, mutant sequences may be 'non-natural' or 'artificial' miRNA family members.

The miR-30 family of microRNAs (miRNAs) can include 5 family members in humans (i.e. miR-30a, miR-30b, miR-30c-1, miR-30c-2, miR-30d, and miR-30e). This family can possess tumor suppressor activity in several types of cancers and suppression of fibrosis, scarring or both. For example, miR-30 downregulation can be linked to poor outcome in recurrent head and neck cancer patients. As such, the miR-30 family is an ideal candidate for miRNA replacement therapy. However, developing miR-30 mimics into novel drug candidates can include overcoming pharmacological barriers for therapeutic application such as: (i) inherent metabolic instability being readily degraded by a variety of nucleases found in biological fluids; (ii) contain sequence patterns (e.g. CpG motifs) and structures that may be natural ligands for cell receptors (i.e. TLR family, RIG-I-like receptors, and other RNA sensors) that trigger the innate immune response that can lead to toxicities in vivo; (iii) poor pharmacology in regards to potency and/or efficacy as natural miRNA sequences may not inherently optimized for mimetics; (iv) delivery in vivo to diseased or target tissues; (v) or any combination thereof.

The miR-29 family of microRNAs (miRNAs) can include 4 family members in humans (i.e. miR-29a, miR-29b-1, miR-29b-2, and miR-29c). This family can possess tumor suppressor activity in several types of cancers, antiviral activity, and suppression of fibrosis, scarring or both. For example, miR-29 overexpression can be linked to reduce Hepatitis C Viral abundance in cell culture. As such, the miR-29 family is an ideal candidate for miRNA replacement therapy. However, developing miR-29 mimics into novel drug candidates can include overcoming pharmacological barriers for therapeutic application such as: (i) inherent metabolic instability being readily degraded by a variety of nucleases found in biological fluids; (ii) contain sequence patterns (e.g. CpG motifs) and structures that may be natural ligands for cell receptors (i.e. TLR family, RIG-I-like receptors, and other RNA sensors) that trigger the innate immune response that can lead to toxicities in vivo; (iii) poor pharmacology in regards to potency and/or efficacy as natural miRNA sequences may not inherently optimized for mimetics; (iv) delivery in vivo to diseased or target tissues; (v) or any combination thereof.

In addition, high-degree of chemical modification and/or implementing conventional modification patterns based on siRNA design can often negatively impact miRNA mimic activity by reducing their pleiotropic effects of silencing multiple transcripts. Chemical modifications can alter sequence recognition of otherwise natural downstream targets. While desirable for improving siRNA specificity towards its intended target by reducing its "miRNA-like" off-target effect, it can be undesirable for miRNA mimetics that are developed to deliberately target multiple transcripts.

An oligonucleotide can comprise a sugar modification. An oligonucleotide can comprise a plurality of sugar modifications. A sugar modification can comprise a glucose or derivative thereof. A sugar modification can comprise a ribose or deoxyribose. A sugar modification can comprise a monosaccharide, a disaccharide, a trisaccharide or any combination thereof.

An oligonucleotide can comprise a chemical modification. An oligonucleotide can comprise a plurality of chemical modifications. An oligonucleotide can comprise a plurality of chemical modifications within a portion of an oligonucleotide, such as a terminal end. A chemical modification can comprise a methyl group, a fluoro group, a methoxyethyl group, an ethyl group, an amide group, an ester group, more than one of any of these, or any combination thereof. A chemical modification can comprise 1-methyl-adenosine, 1-methyl-guanosine, 1-methyl-inosine, 2,2-dimethyl-guanosine, 2,6-diaminopurine, 2'-amino-2'-deoxyadenosine, 2'-amino-2'-deoxycytidine, 2'-amino-2'-deoxyguanosine, 2'-amino-2'-deoxyuridine, 2-amino-6-chloropurineriboside, 2-aminopurine-riboside, 2'-araadenosine, 2'-aracytidine, 2'-arauridine, 2'-azido-2'-deoxyadenosine, 2'-azido-2'-deoxycytidine, 2'-azido-2'-deoxyguanosine, 2'-azido-2'-deoxyuridine, 2-chloroadenosine, 2'-fluoro-2'-deoxyadenosine, 2'-fluoro-2'-deoxycytidine, 2'-fluoro-2'-deoxyguanosine, 2'-fluoro-2'-deoxyuridine, 2'-fluorothymidine, 2-methyl-adenosine, 2-methyl-guanosine, 2-methyl-thio-N6-isopenenyl-adenosine, 2'-O-methyl-2-aminoadenosine, 2'-O-methyl-2'-deoxyadenosine, 2'-O-methyl-2'-deoxycytidine, 2'-O-methyl-2'-deoxyguanosine, 2'-O-methyl-2'-deoxyuridine, 2'-O-methyl-5-methyluridine, 2'-O-methylinosine, 2'-O-methylpseudouridine, 2-thiocytidine, 2-thio-cytidine, 3-methyl-cytidine, 4-acetyl-cytidine, 4-thiouridine, 5-(carboxyhydroxymethyl)-uridine, 5,6-dihydrouridine, 5-aminoallylcytidine, 5-aminoallyl-deoxyuridine, 5-bromouridine, 5-carboxymethylaminomethyl-2-thio-uracil, 5-carboxymethylaminomethyl-uracil, 5-chloro-ara-cytosine, 5-fluoro-uridine, 5-iodouridine, 5-methoxycarbonylmethyl-uridine, 5-methoxy-uridine, 5-methyl-2-thio-uridine, 6-Azacytidine, 6-azauridine, 6-chloro-7-deaza-guanosine, 6-chloropurineriboside, 6-mercapto-guanosine, 6-methyl-mercaptopurine-riboside, 7-deaza-2'-deoxy-guanosine, 7-deazaadenosine, 7-methyl-guanosine, 8-azaadenosine, 8-bromo-adenosine, 8-bromo-guanosine, 8-mercapto-guanosine, 8-oxoguanosine, benzimidazole-riboside, beta-D-mannosyl-queosine, dihydro-uridine, inosine, N1-methyladenosine, N6-([6-aminohexyl] carbamoylmethyl)-adenosine, N6-isopentenyl-adenosine, N6-methyl-adenosine, N7-methyl-xanthosine, N-uracil-5-oxyacetic acid methyl ester, puromycin, queosine, uracil-5-oxyacetic acid, uracil-5-oxyacetic acid methyl ester, wybutoxosine, xanthosine, xylo-adenosine, or any combination thereof.

In some cases, the engineered oligonucleotide can comprise a chemical modification, such as a chemical modification to a base or a sugar of the engineered oligonucleotide, relative to a natural base or sugar. In some cases, the engineered oligonucleotide can comprise more than one chemical modification, such as a plurality of chemical modifications. A portion of bases or a portion of sugars of the engineered oligonucleotide can comprise one or more chemical modifications. In some cases, about: 10%, 20%, 30%, 40%, 50%, 60%, 70%, 80%, 90% or more of bases or sugars in an engineered oligonucleotide can be chemically modified.

In some cases, a ribonucleotide (or in some cases a deoxynucleotide), can be modified, such as the base component, the sugar (ribose) component, the phosphate component forming the backbone of the engineered oligonucleotide, or any combination thereof, by a chemical modification as described herein.

In some cases, an engineered oligonucleotide can be engineered or modified to increase a specificity for an RNA sequence among a plurality of RNA sequences. An engineered oligonucleotide can be modified to significantly increase a specificity for an RNA sequence among a plurality of RNA sequences. Increased specificity can be compared to a comparable oligonucleotide that may not be engineered or can be compared to a comparable oligonucleotide that may be engineered or modified in a different way. A specificity may be increased by at least about: 2%, 5%, 10%, 15%, 20%, 25%, 30%, 35%, 40%, 45%, 50%, 55%, 60%, 65%, 70%, 75%, 80%, 85%, 90%, 95% or more as compared to a comparable oligonucleotide. An engineered oligonucleotide can be engineered or modified to increase a specificity for a first RNA sequence as compared to a second RNA sequence In some cases, an engineered oligonucleotide can be selective for an RNA sequence encoding a gene, such as a gene implicated in a disease or condition as described herein, such as an oncogene. In some cases, the engineered oligonucleotide can be selective for an RNA sequence encoding an oncogene, among a plurality of RNA sequences. In some cases, an engineered oligonucleotide can comprise an increased specificity for an RNA sequence encoding a gene, such as an oncogene, among a plurality of RNA sequences. In some cases, an engineered oligonucleotide can be selective for an RNA sequence encoding ITGA6, SERPINE1, EGFR, or any combination thereof, among a plurality of RNA sequences.

A chemically modified nucleotide as used herein can be guanosine, uridine, adenosine, thymidine or cytosine including, without implying any limitation, any natively occurring or non-natively occurring guanosine, uridine, adenosine, thymidine or cytidine that has been altered chemically, for example by acetylation, methylation, hydroxylation, etc., including 1-methyl-adenosine, 1-methyl-guanosine, 1-methyl-inosine, 2,2-dimethyl-guanosine, 2,6-diaminopurine, 2'-amino-2'-deoxyadenosine, 2'-amino-2'-deoxycytidine, 2'-amino-2'-deoxyguanosine, 2'-amino-2'-deoxyuridine, 2-amino-6-chloropurineriboside, 2-aminopurine-riboside, 2'-araadenosine, 2'-aracytidine, 2'-arauridine, 2'-azido-2'-deoxyadenosine, 2'-azido-2'-deoxycytidine, 2'-azido-2'-deoxyguanosine, 2'-azido-2'-deoxyuridine, 2-chloroadenosine, 2'-fluoro-2'-deoxyadenosine, 2'-fluoro-2'-deoxycytidine, 2'-fluoro-2'-deoxyguanosine, 2'-fluoro-2'-deoxyuridine, 2'-fluorothymidine, 2-methyl-adenosine, 2-methyl-guanosine, 2-methyl-thio-N6-isopenenyl-adenosine, 2'-O-methyl-2-aminoadenosine, 2'-O-methyl-2'-deoxyadenosine, 2'-O-methyl-2'-deoxycytidine, 2'-O-methyl-2'-deoxyguanosine, 2'-O-methyl-2'-deoxyuridine, 2'-O-methyl-5-methyluridine, 2'-O-methylinosine, 2'-O-methylpseudouridine, 2-thiocytidine, 2-thio-cytidine, 3-methyl-cytidine, 4-acetyl-cytidine, 4-thiouridine, 5-(carboxyhydroxymethyl)-uridine, 5,6-dihydrouridine, 5-aminoallylcytidine, 5-aminoallyl-deoxyuridine, 5-bromouridine, 5-carboxymethylaminomethyl-2-thio-uracil, 5-carboxymethylamonomethyl-uracil, 5-chloro-ara-cytosine, 5-fluoro-uridine, 5-iodouridine, 5-methoxycarbonylmethyl-uridine, 5-methoxy-uridine, 5-methyl-2-thio-uridine, 6-Azacytidine, 6-azauridine, 6-chloro-7-deaza-guanosine, 6-chloropurineriboside, 6-mercapto-guanosine, 6-methyl-mercaptopurine-riboside, 7-deaza-2'-deoxy-guanosine, 7-deazaadenosine, 7-methyl-guanosine, 8-azaadenosine, 8-bromo-adenosine, 8-bromo-guanosine, 8-mercapto-guanosine, 8-oxoguanosine, benzimidazole-riboside, beta-D-mannosyl-queosine, dihydro-uridine, inosine, N1-methyladenosine, N6-([6-aminohexyl] carbamoylmethyl)-adenosine, N6-isopentenyl-adenosine, N6-methyl-adenosine, N7-methyl-xanthosine, N-uracil-5-oxyacetic acid methyl ester, puromycin, queosine, uracil-5-oxyacetic acid, uracil-5-oxyacetic acid methyl ester, wybutoxosine, xanthosine, or xylo-adenosine. The preparation of such variants is known to the person skilled in the art, for example from U.S. Pat. No. 4,373,071, 4,401,796, 4,415,732, 4,458,066, 4,500,707, 4,668,777, 4,973,679, 5,047,524, 5,132,418, 5,153,319, 5,262,530 or 5,700,642.

In some cases, the engineered nucleotide can comprise a chemically modified nucleotide such as 2-amino-6-chloropurineriboside-5'-triphosphate, 2-aminopurine-riboside-5'-triphosphate, 2-aminoadenosine-5'-triphosphate, 2'-amino-2'-deoxycytidine-triphosphate, 2-thiocytidine-5'-triphosphate, 2-thiouridine-5'-triphosphate, 2'-fluorothymidine-5'-triphosphate, 2'-O-methyl-inosine-5'-triphosphate, 4-thiouridine-5'-triphosphate, 5-aminoallycytidine-5'-triphosphate, 5-aminoallyluridine-5'-triphosphate, 5-bromocytidine-5'-triphosphate, 5-bromouridine-5'-triphosphate, 5-bromo-2'-deoxycytidine-5'-triphosphate, 5-bromo-2'-deoxyuridine-5'-triphosphate, 5-iodocytidine-5'-triphosphate, 5-iodo-2'-deoxycytidine-5'-triphosphate, 5-iodouridine-5'-triphosphate, 5-iodo-2'-deoxyuridine-5'-triphosphate, 5-methylcytidine-5'-triphosphate, 5-methyluridine-5'-triphosphate, 5-propynyl-2'-deoxycytidine-5'-triphosphate, 5-propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, puromycin-5'-triphosphate, xanthosine-5'-triphosphate, or any combination thereof.

In some cases, the engineered oligonucleotide can comprise a chemically modified nucleotide such as pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, 4-methoxy-2-thio-pseudouridine, or any combination thereof.

In some cases, the engineered oligonucleotide can comprise a chemically modified nucleotide such as 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, or any combination thereof.

In some cases, the engineered oligonucleotide can comprise a chemically modified nucleotide such as 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2, 6-diaminopurine, 7-deaza-8-aza-2, 6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, 2-methoxy-adenine, or any combination thereof.

In some cases, the engineered oligonucleotide can comprise a chemically modified nucleotide such as inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methyl-guanosine, N2,N2-dimethylguanosine, 8-oxo-guanosine, 7-methyl-8-oxo-guanosine, 1-methyl-6-thio-guanosine, N2-methyl-6-thio-guanosine, N2,N2-dimethyl-6-thio-guanosine, or any combination thereof.

In some cases, the engineered oligonucleotide can comprise a chemically modified nucleotide such as 6-aza-cytidine, 2-thio-cytidine, alpha-thio-cytidine, pseudo-iso-cytidine, 5-aminoallyl-uridine, 5-iodo-uridine, N1-methyl-pseudouridine, 5,6-dihydrouridine, alpha-thio-uridine, 4-thio-uridine, 6-aza-uridine, 5-hydroxy-uridine, deoxy-thymidine, 5-methyl-uridine, pyrrolo-cytidine, inosine, alpha-thio-guanosine, 6-methyl-guanosine, 5-methyl-cytidine, 8-oxo-guanosine, 7-deaza-guanosine, N1-methyl-adenosine, 2-amino-6-chloro-purine, N6-methyl-2-amino-purine, pseudo-iso-cytidine, 6-chloro-purine, N6-methyl-adenosine, alpha-thio-adenosine, 8-azido-adenosine, 7-deaza-adenosine, or any combination thereof.

In some cases, the engineered oligonucleotide can comprise a chemically modified nucleotide, which can be chemically modified at the 2' position. The chemically modified oligonucleotide can comprise a substituent at the 2' carbon atom, wherein the substituent can comprise a halogen, an alkoxy group, a hydrogen, an aryloxy group, an amino group or an aminoalkoxy group, such as a 2'-hydrogen (2'-deoxy), 2'-O-methyl, 2'-O-methoxyethyl, 2'-fluoro, 2' Methoxyethyl, 2'-fluoro, Locked Nucleic acid, or any combination thereof.

Another chemical modification (such as one involving the 2' position of a nucleotide) can be a locked nucleic acid (LNA) nucleotide, an ethylene bridged nucleic acid (ENA) nucleotide, an (S)-constrained ethyl cEt nucleotide, a bridged nucleic acid (BNA) or any combination thereof. A backbone modification can lock the sugar of the modified nucleotide into a preferred northern conformation. In some case, a presence of that type of modification in the target sequence of the engineered oligonucleotide can allow for stronger and faster binding of the targeting sequence to the target site.

In some cases, the engineered oligonucleotide can comprise at least one chemically modified nucleotide, wherein the phosphate backbone, which can be incorporated into the engineered oligonucleotide, can be modified. One or more phosphate groups of the backbone can be modified, for example, by replacing one or more of the oxygen atoms with a different substituent. Further, the modified nucleotide can include a full replacement of an unmodified phosphate moiety with a modified phosphate as described herein. Examples of modified phosphate groups can include a phosphorothioate, a methylphosphonate, a phosphoroselenoate, a borano phosphate, a borano phosphate ester, a hydrogen phosphonate, a phosphoroamidate, an alkyl phosphonate, an aryl phosphonate or a phosphotriester. The phosphate linker can also be modified by the replacement of a linking oxygen with nitrogen (bridged phosphoroamidates), sulfur (bridged phosphorothioates) and carbon (bridged methylene-phosphonates).

In some cases, the engineered oligonucleotide can comprise a sugar modification. The sugar modification can comprise a conjugate, such as a linker. In some cases, the engineered oligonucleotide can comprise one or more linker groups. The engineered oligonucleotide can be linked to an antibody, a protein, a lipid, an aptamer, a small molecule, a drug, or any combination thereof. A linker can form a covalent bond. The engineered oligonucleotide can be linked to one or more engineered oligonucleotides, such as a second engineered oligonucleotide via a linker. In some cases, the linker may be a cleavable linker. In some cases, a linker can comprise an azide linker. An engineered oligonucleotide can comprise a base of a nucleotide that is glycosylated with a glycan. In some cases, the engineered oligonucleotide can comprise an abasic site, such as a nucleotide lacking an organic base. In some cases, the abasic nucleotide can comprise a chemical modification as described herein, such as at the 2' position of the ribose. In some cases, the 2' C atom of the ribose can be substituted with a substituent such as a halogen, an alkoxy group, a hydrogen, an aryloxy group, an amino group or an aminoalkoxy group, in some cases from 2'-hydrogen (2'-deoxy), 2'-O-methyl, 2'-O-methoxyethyl or 2'-fluoro. In some cases, an abasic site nucleotide can comprise structures 1 A or 1 B:

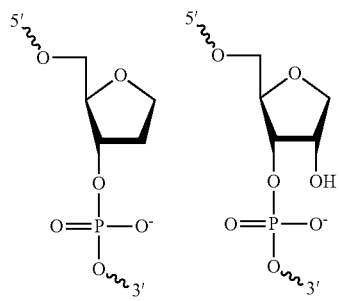

dSpacer (1A) rSpacer (1 B)

In some cases, the engineered oligonucleotide can be modified by the addition of a '5'-CAP' structure. A 5'-cap can be an entity, such as a modified nucleotide entity, which can 'cap' the 5'-end of a mature miRNA. A 5'-cap can typically be formed by a modified nucleotide, particularly by a derivative of a guanine nucleotide. In some cases, the 5'-cap can be linked to the 5'-terminus of the engineered oligonucleotide via a 5'-51-triphosphate linkage. A 5'-cap can be methylated, e.g. m7GpppN, wherein N can be the terminal 5' nucleotide of the nucleic acid carrying the 5'-cap, such as the 5'-end of an RNA. A 5'-cap structure can include glyceryl, inverted deoxy abasic residue (moiety), 4', 5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 di hydroxy pentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. In some cases, a modified 5'-CAP structure can comprise a CAP1 (methylation of the ribose of the adjacent nucleotide of m7G), CAP2 (methylation of the ribose of the 2nd nucleotide downstream of the m7G), CAP3 (methylation of the ribose of the 3rd nucleotide downstream of the m7G), CAP4 (methylation of the ribose of the 4th nucleotide downstream of the m7G), ARCA (anti-reverse CAP analogue, modified ARCA (e.g. phosphothioate modified ARCA), inosine, N1-methylguanosine, 2'-fluoro-guanosine, 7-deaza-guanosine, 8-oxo-guanosine, 2-amino-guanosine, LNA-guanosine, or 2-azido-guanosine.

The term "epigenetic marker" as used herein, can be any covalent modification of a nucleic acid base. In some cases, a covalent modification can comprise adding a methyl group, a hydroxymethyl group, a carbon atom, an oxygen atom, or any combination thereof to one or more bases of a nucleic acid sequence. In some cases, a covalent modification can comprise changing an oxidation state of a molecule associated with a nucleic acid sequence, such as an oxygen atom, or a combination thereof. A covalent modification can occur at any base, such as a cytosine, a thymine, a uracil, an adenine, a guanine, or any combination thereof. In some cases, an epigenetic modification can comprise an oxidation or a reduction. A nucleic acid sequence can comprise one or more epigenetically modified bases. An epigenetically modified base can comprise any base, such as a cytosine, a uracil, a thymine, adenine, or a guanine. An epigenetically modified base can comprise a methylated base, a hydroxymethylated base, a formylated base, or a carboxylic acid containing base or a salt thereof. An epigenetically modified base can comprise a 5-methylated base, such as a 5-methylated cytosine (5-mC). An epigenetically modified base can comprise a 5-hydroxymethylated base, such as a 5-hydroxymethylated cytosine (5-hmC). An epigenetically modified base can comprise a 5-formylated base, such as a 5-formylated cytosine (5-fC). An epigenetically modified base can comprise a 5-carboxylated base or a salt thereof, such as a 5-carboxylated cytosine (5-caC). In some cases, an epigenetically modified base can comprise a methyltransferase-directed transfer of an activated group (mTAG).

An epigenetically modified base can comprise one or more bases or a purine (such as Structure 1) or one or more bases of a pyrimidine (such as Structure 2). An epigenetic modification may occur at one or more of any positions. For example, an epigenetic modification can occur at one or more positions of a purine, including positions 1, 2, 3, 4, 5, 6, 7, 8, 9, as shown in Structure 1. In some cases, an epigenetic modification can occur at one or more positions of a pyrimidine, including positions 1, 2, 3, 4, 5, 6, as shown in Structure 2.

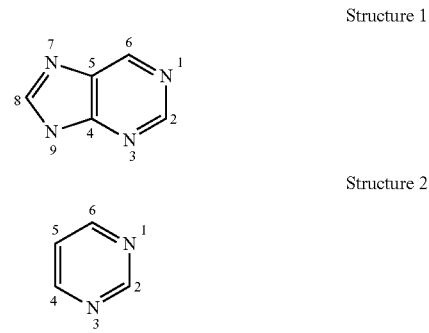

A nucleic acid sequence may comprise an epigenetically modified base. A nucleic acid sequence may comprise a plurality of epigenetically modified bases. A nucleic acid sequence may comprise an epigenetically modified base positioned within a CG site, a CpG island, or a combination thereof. A nucleic acid sequence may comprise different epigenetically modified bases, such as a methylated base, a hydroxymethylated base, a formylated base, a carboxylic acid containing base or a salt thereof, a plurality of any of these, or any combination thereof.

In some cases, an engineered oligonucleotide or salt thereof, when chemically modified, can be of formula: Guide Pattern 1, Guide Pattern 2, or Guide Pattern 3 as shown in Table 7.

TABLE 7

Chemical modification patterns

| Pattern | Sequence (5'-3') |
|---|---|
| Guide Pattern 1 | $(N)_a(mN)_b(N)_cNN$ |
| Guide Pattern 2 | $(N)_a(mN)_b(N)_c sfNsmN$ |

TABLE 7-continued

Chemical modification patterns

| Pattern | Sequence (5'-3') |
|---|---|
| Guide Pattern 3 | (fNmN)$_h$(mN)$_i$(fNmN)$_j$sfNsmN |
| Passenger Pattern 1 | CAP-mNmNmN(N)$_k$mNmNmN |

N can be any natural or non-natural nucleotide; mN can be a 2'-O-methyl-modified uracil, guanine, adenine, or cytosine; s can be a phosphothionate-modified backbone; fN can be 2'fluoro-modified uracil, guanine, adenine, or cytosine; CAP can be 5'-terminal methyl group (5'-OMethyl) or alkylamino group such as amino-carbon 6 chain (5'-Amino C6); a can be from 8-10; b can be from 7-10; c can be from 2-4; h can be 5-7; i can be 0 or 1; j can be 3-4; and k can be 12-19.

An engineered oligonucleotide or salt thereof, when chemically modified, can have at least 90% sequence identity to any one of SEQ ID NOs: 52-89, 127-154, 184-201, 205-222, 225-233, 235-243, 264-443, 445-453, 455-463, 620, 644-825, 835-837, and 846-899.

In some cases, a vector can be used for miR delivery, in an in vitro setting, in vivo setting, or any combination thereof. In some cases, the vector can be targeted to but may not be limited to a mammal, or a specific organ, or a specific cell, or any combination thereof. The vector can comprise any composition described herein. In some cases, the vector can comprise more than one composition, such as a miR-30 family construct and a second miR-29 family construct, or a miR-30 family construct and a second miR-30 family construct, or a miR-29 family construct and a second miR-29 family construct, or any combination thereof. In some cases, the vector can be comprised of a liposome, a nanoparticle or any combination thereof. The liposome can include but may not be limited to unilamellar liposome, multilamellar liposome, archaeosome, niosome, novasome, cryptosome, emulsome, vesosome, or a derivative of any of these, or any combination thereof. The nanoparticle can include but may not be limited to biopolymeric nanoparticle, alginate nanoparticle, xanthan gum nanoparticle, cellulose nanoparticle, dendrimer, polymeric micelle, polyplexed, inorganic nanoparticle, nanocrystal, metallic nanoparticle, quantum dot, protein nanoparticle, polysaccharide nanoparticle, or a derivative of any of these, or any combination thereof. In some cases, the vector can be an RNA viral vector which can include but may not be limited to a retrovirus, lentivirus, coronavirus, alphavirus, flavivirus, rhabdovirus, morbillivirus, picornavirus, coxsackievirus, or picornavirus or portions of any of these, or fragments of any of these, or any combination thereof. In some cases, the vector can be a DNA viral vector which can include but may not be limited to an adeno-associated viral (AAV) vector, adenovirus, hybrid adenoviral system, hepadnavirus, parvovirus, papillomavirus, polyomavirus, herpesvirus, poxvirus, a portion of any of these, or a fragment of any of these, or any combination thereof.

Compositions and methods are described herein can include miR mimics. Such miR mimics can contain one or more sequence modifications, one or more chemical modifications, or a combination thereof that can: enhance stability of the miR mimic; substantially reduce or eliminate immune stimulation (such as via the innate immune response); improve pharmacological activity of the miR mimic; retain poly-targeting effects of the miR mimic; or any combination thereof. Engineered miR family members comprising sequence alterations in the guide strand can bias target recognition toward two or more clinical targets.

As used herein, a "biosimilar" or a "biosimilar product" can refer to a biological product that is licensed based on a showing that it is substantially similar to an FDA-approved biological product, known as a reference product, and has no clinically meaningful differences in terms of safety and effectiveness from the reference product. Only minor differences in clinically inactive components may be allowable in biosimilar products. A "biosimilar" of an approved reference product/biological drug refers to a biologic product that is similar to the reference product based upon data derived from (a) analytical studies that demonstrate that the biological product is highly similar to the reference product notwithstanding minor differences in clinically inactive components; (b) animal studies (including the assessment of toxicity); and/or (c) a clinical study or studies (including the assessment of immunogenicity and pharmacokinetics or pharmacodynamics) that are sufficient to demonstrate safety, purity, and potency in one or more appropriate conditions of use for which the reference product is licensed and intended to be used and for which licensure is sought for the biological product. In some embodiments, the biosimilar biological product and reference product utilize the same mechanism or mechanisms of action for the condition or conditions of use prescribed, recommended, or suggested in the proposed labeling, but only to the extent the mechanism or mechanisms of action are known for the reference product. In some embodiments, the condition or conditions of use prescribed, recommended, or suggested in the labeling proposed for the biological product have been previously approved for the reference product. In some embodiments, the route of administration, the dosage form, and/or the strength of the biological product are the same as those of the reference product. In some embodiments, the facility in which the biological product is manufactured, processed, packed, or held may meet standards designed to assure that the biological product continues to be safe, pure, and potent. The reference product may be approved in at least one of the U.S., Europe, or Japan. In some embodiments, a response rate of human subjects administered the biosimilar product can be 50%-150% of the response rate of human subjects administered the reference product. For example, the response rate of human subjects administered the biosimilar product can be 50%-100%, 50%-110%, 50%-120%, 50%-130%, 50%-140%, 50%-150%, 60%-100%, 60%-110%, 60%-120%, 60%-130%, 60%-140%, 60%-150%, 70%-100%, 70%-110%, 70%-120%, 70%-130%, 70%-140%, 70%-150%, 80%-100%, 80%-110%, 80%-120%, 80%-130%, 80%-140%, 80%-150%, 90%-100%, 90%-110%, 90%-120%, 90%-130%, 90%-140%, 90%-150%, 100%-110%, 100%-120%, 100%-130%, 100%-140%, 100%-150%, 110%-120%, 110%-130%, 110%-140%, 110%-150%, 120%-130%, 120%-140%, 120%-150%, 130%-140%, 130%-150%, or 140%-150% of the response rate of human subjects administered the reference product. In some embodiments, a biosimilar product and a reference product can utilize the same mechanism or mechanisms of action for the condition or conditions of use prescribed, recommended, or suggested in the proposed labeling, but only to extent the mechanism or mechanisms are known for the reference product. To obtain approval for biosimilar drugs, studies and data of structure, function, animal toxicity, pharmacokinetics, pharmacodynamics, immunogenicity, and clinical safety and efficacy may be needed. A biosimilar may also be known as a follow-on biologic or a subsequent entry biologic. In some embodiments, a biosimilar product may be substantially similar to the reference product notwithstanding minor different in clinically inactive components.

As used herein, an "interchangeable biological product" may refer to a biosimilar of an FDA-approved reference product and may meet additional standards for interchangeability. In some embodiments, an interchangeable biological product can, for example, produce the same clinical result as the reference product in any given subject. In some embodiments, an interchangeable product may contain the same amount of the same active ingredients, may possess comparable pharmacokinetic properties, may have the same clinically significant characteristics, and may be administered in the same way as the reference compound. In some embodiments, an interchangeable product can be a biosimilar product that meets additional standards for interchangeability. In some embodiments, an interchangeable product can produce the same clinical result as a reference product in all the reference product's licensed conditions of use. In some embodiments, an interchangeable product can be substituted for the reference product by a pharmacist without the intervention of the health care provider who prescribed the reference product. In some embodiments, when administered more than once to an individual, the risk in terms of safety or diminished efficacy of alternating or switching between use of the biological product and the reference product is not greater than the risk of using the reference product without such alternation or switch. In some embodiments, an interchangeable product can be a regulatory agency approved product. In some embodiments, a response rate of human subjects administered the interchangeable product can be 80%-120% of the response rate of human subjects administered the reference product. For example, the response rate of human subjects administered the interchangeable product can be 80%-100%, 80%-110%, 80%-120%, 90%-100%, 90%-110%, 90%-120%, 100%-110%, 100%-120%, or 110%-120 of the response rate of human subjects administered the reference product.

In some cases, at least a portion of the RNA sequence can be encoded by an oncogene. The oncogene can comprise ABL1, ABL2, AKT1, AKT2, AKT3, ATF1, BCL11A, BCL2, BCL3, BCL6, BCR, BRAF, CARD11, CBLB, CBLC, CCND1, CCND2, CCND3, CDX2, CTNNB1, DDB2, BBIT3, BBX6, DEK, EGFR, ELK4, ERBB2, ERBB3, E2F1, ETV4, ETV6, EVI1, EWSR1, FEV, FGFR1, FGFR1OP, FGR2, FUS, GOLGA5, GOPC, HMGA1, HMGA2, HRAS, IRF4, ITGA6, JUN, KIT, KRAS, LCK, LMO2, MAF, MAFB, MAML2, MDM2, MET, MITF, MLL, MPL, MYB, MYC, MYCL1, MYCN, NCOA4, NFKB2, NRAS, NTRK1, NUP214, PAX8, PDGFB, PIK3CA, PIM1, PLAG1, PPARG, PTPN11, RAF1, REL, RET, ROS1, SERPINE1, SMO, SS18, TCL1A, TET2, TFG, TLX1, TPR, USP6, or any combination thereof. In some cases, the oncogene can comprise ITGA6, BCL2, DEK, PLAG1, SERPINE1, MYCN, LMO2, PIM1, EGFR, IRS1, NT5E, EGFR, GLDC, SOCS1, STAT1, LOX, PDGFRB, WNT5A, CD80, CCNA1, THBS2, IGF1R, AFAP1L2, CTHRC1, MET, FAP, SERPINE1, IL1A, GJA1, MYBL2, CDK6, ATG9A, SETDB1 or any combination thereof. In some cases, an engineered oligonucleotide or salt thereof as described herein can be selective for one or more particular RNA sequences among a plurality of RNA sequences. For example, an engineered oligonucleotide or salt thereof as described herein can be selective for one or more of ABL1, ABL2, AKT1, AKT2, ATF1, BCL11A, BCL2, BCL3, BCL6, BCR, BRAF, CARD11, CBLB, CBLC, CCND1, CCND2, CCND3, CDX2, CTNNB1, DDB2, BBIT3, BBX6, DEK, EGFR, ELK4, ERBB2, ETV4, ETV6, EVI1, EWSR1, FEV, FGFR1, FGFR1OP, FGR2, FUS, GOLGA5, GOPC, HMGA1, HMGA2, HRAS, IRF4, ITGA6, JUN, KIT, KRAS, LCK, LMO2, MAF, MAFB, MAML2, MDM2, MET, MITF, MLL, MPL, MYB, MYC, MYCL1, MYCN, NCOA4, NFKB2, NRAS, NTRK1, NUP214, PAX8, PDGFB, PIK3CA, PIM1, PLAG1, PPARG, PTPN11, RAF1, REL, RET, ROS1, SERPINE1, SMO, SS18, TCL1A, TET2, TFG, TLX1, TPR, USP6, relative to a plurality of other RNA sequences.

A portion of an RNA sequence can be at least about: 70%, 75%, 80%, 85%, 90%, 95% of the bases of an RNA sequence.

In some cases, the disease or condition can comprise fibrosis. In some cases, at least a portion of the RNA sequence can be encoded by a collagen super family gene, a platelet-derived growth factor gene, a TGF-β signaling gene, a collagen remodeling gene, an extracellular matrix remodeling gene, a Wnt signaling gene, a hepatoma-derived growth factor (HDGF) signaling gene, or any combination thereof. In some cases, at least a portion of the RNA sequence can be encoded by COL1A1, COL11A1, COL2A1, COL5A3, COL5A2, COL4A4, COL21A1, COL7A1, COL9A1, COL19A1, COL5A1, COL22A1, COL8A1, COL4A2, COL6A2, COL24A1, COL4A3, COL4A6, COL25A1, COL16A1, COL15A1, or any combination thereof. In some cases, at least a portion of the RNA sequence can be encoded by the platelet-derived growth factor gene, such as PDGFB, PDGFC, or PDGFRB. In some cases, at least a portion of the RNA sequence can be encoded by the TGF-β signaling gene (such as WISP1 or TGFB2). In some cases, at least a portion of the RNA sequence can be encoded by the collagen remodeling gene (such as LOXL2). In some cases, at least a portion of the RNA sequence can be encoded by the extracellular matrix remodeling gene (such as COL1A1, COL11A1, COL2A1, COL5A3, COL5A2, COL4A4, COL21A1, COL7A1, COL9A1, COL19A1, COL5A1, COL22A1, COL8A1, COL4A2, COL6A2, COL24A1, COL4A3, COL4A6, COL25A1, COL16A1, COL15A1, LOXL2, or Elastin). In some cases, at least a portion of the RNA sequence can be encoded by the Wnt signaling gene (such as WISP1). In some cases, at least a portion of the RNA sequence can be encoded by the HDGF signaling gene (such as HDGF). A portion can be at least about: 60%, 70%, 80%, 90%, 95% of the bases on the RNA sequence.

In some cases, the engineered oligonucleotide or salt thereof can be from about 5 to about 50 nucleotides in length. In some cases, the engineered oligonucleotide or salt thereof can be from about 5 to about 40 nucleotides in length. In some cases, the engineered oligonucleotide or salt thereof can be from about 5 to about 30 nucleotides in length. In some cases, the engineered oligonucleotide or salt thereof can be from about 5 to about 25 nucleotides in length. In some cases, the engineered oligonucleotide or salt thereof can be from about 5 to about 60 nucleotides in length. In some cases, the engineered oligonucleotide or salt thereof can be from about 5 to about 80 nucleotides in length. In some cases, the engineered oligonucleotide or salt thereof can be from about 5 to about 100 nucleotides in length. In some cases, the engineered oligonucleotide or salt thereof can be from about 5 to about 200 nucleotides in length.

In some cases, the engineered oligonucleotide or salt thereof, when contacted with the mRNA sequence, can produce at least about: 1.1, 1.2, 1.3, 1.4, 1.5, 1.6, 1.7, 1.8, 1.9, 2, 3, 4, 5, 6, 7, 8, 9, 10 fold lower expression of a polypeptide encoded by the mRNA sequence, as compared to contacting an equivalent amount of the otherwise comparable oligonucleotide with the mRNA sequence. Lower expression can be from about 1.2-fold to about 10-fold lower expression.

In some cases, the engineered oligonucleotide or salt thereof, when contacted with the mRNA sequence, can produce at least about: 1.1, 1.2, 1.3, 1.4, 1.5, 1.6, 1.7, 1.8, 1.9, 2, 3, 4, 5, 6, 7, 8, 9, 10 fold lower activity of a polypeptide encoded by the mRNA sequence, as compared to contacting an equivalent amount of the otherwise comparable oligonucleotide with the mRNA sequence. Lower activity can be from about 1.2-fold to about 10-fold lower activity.

In some cases, at least about: 70%, 7%, 80%, 85%, 90%, 95% of an initial amount of the engineered oligonucleotide or salt thereof remains when the engineered oligonucleotide or salt thereof can be stored in a closed container placed in a room for a time period of at least about: 1 month, 2 months, 3 months, 4 months, 5 months, 6 months at about from about 21 to about 25 degrees Celsius (such as about: 21, 22, 23, 24, 25 degrees Celsius) with a relative atmospheric humidity of from about 45% to about 55% (such as about: 45%, 46%, 47%, 48%, 49%, 50%, 51%, 52%, 53%, 54%, 55%). In some cases, the time period can be from about 1 month to about 1 year. In some cases, the time period can be from about 1 month to about 2 year. In some cases, the time period can be from about 1 month to about 6 months. In some cases, the time period can be from about 1 month to about 3 year. In some cases, the time period can be from about 1 month to about 9 months.

The disease or condition can comprise a viral infection such as a SARS virus infection, a Covid-19 viral infection, or an HCV Genotype 1 infection. In some cases, at least a portion of the RNA sequence can be encoded in a coronavirus genome (e.g. a SARS-CoV, a SARS-CoV2, a MERS-CoV, or a CoV-HKU1 genome). The RNA sequence can comprise at least about: 70%, 75%, 80%, 85%, 90%, 95% sequence identity to a sequence recited in SEQ ID NOS: 500-531, 829-831 (Table 6), SEQ ID NOS: 474-499, 826-828 (Table 6), SEQ ID NOS: 532-554 (Table 6), or SEQ ID NOS: 555-586 (Table 6). In some cases, an RNA sequence can comprise at least about: 70%, 75%, 80%, 85%, 90%, 95% sequence identity to SEQ ID NO: 476, SEQ ID NO: 481, or SEQ ID NO: 495. The RNA sequence can comprise at least about: 5, 10, 15, 20 contiguous bases having at least about: 70%, 75%, 80%, 85%, 90%, 95% sequence identity to SEQ ID NO: 476, SEQ ID NO: 481, or SEQ ID NO: 495. In some cases, at least a portion of the RNA sequence can be encoded in an HCV Genotype 1 genome. The RNA sequence can comprise at least about: 70%, 75%, 80%, 85%, 90%, 95% sequence identity to SEQ ID NO: 587, SEQ ID NO: 588, or SEQ ID NO: 589. The RNA sequence can comprise at least about: 5, 10, 15, 20 contiguous bases having at least about: 70%, 75%, 80%, 85%, 90%, 95% sequence identity to SEQ ID NO: 587, SEQ ID NO: 588, or SEQ ID NO: 589. In some cases, at least a portion of the RNA sequence is encoded in a SARS-CoV-2 virus genome. The RNA sequence can comprise at least about: 70%, 75%, 80%, 85%, 90%, 95% sequence identity to SEQ ID NO: 500, SEQ ID NO: 513, or SEQ ID NO: 518. The RNA sequence can comprise at least about: 5, 10, 15, 20 contiguous bases having at least about: 70%, 75%, 80%, 85%, 90%, 95% sequence identity to SEQ ID NO: 500, SEQ ID NO: 513, or SEQ ID NO: 518.

An engineered oligonucleotide or salt thereof can comprise at least about: 70%, 75%, 80%, 85%, 90%, 95% or more sequence identity to any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949, or any combination thereof. An engineered oligonucleotide or salt thereof can comprise at least about 5, 10, 15, 20 contiguous bases having at least about: 70%, 75%, 80%, 85%, 90%, 95% or more sequence identity to any one of SEQ ID NOs: 1-5, 12-14, 19-20, 24-25, 28, 30, 32, 34, 36, 38-45, 52-89, 100-154, 184-201, 205-222, 225-233, 235-243, 245-443, 445-453, 455-463, 465, 620, 624-825, 835-837, 840-899, and 901-949, or any combination thereof.

A change in polypeptide expression, such as a fold lower or fold greater expression, can be determined by methods as described herein. For example, the engineered oligonucleotide or salt thereof can be contacted with an mRNA sequence and compared to contacting an equivalent amount of an miR-29 or miR-30 oligonucleotide naturally present in a cell. The change in expression can be determined by: (a) transfecting the engineered oligonucleotide into a first isolated cell comprising the mRNA sequence, (b) transfecting the miR-29 or miR-30 oligonucleotide into a second isolated cell comprising the mRNA sequence, and (c) measuring an amount of the polypeptide expressed in the first isolated cell and the isolated second cell.

A nucleic acid construct can comprise a first strand comprising the engineered oligonucleotide and a second strand comprising a sequence complementary to at least a portion of the engineered oligonucleotide. The second strand may be complementary to at least about 10%, 20%, 30%, 40%, 50%, 60%, 70%, 80%, 90% or more of the first strand. The second strand may be complementary to at least about: 5, 10, 15, or 20 contiguous bases of the first strand. A nucleic acid construct may comprise an end overhang, such as a 5' end or a 3' end. The first strand, the second strand or a combination thereof may comprise one or more chemical modifications. At least about 10%, 20%, 30%, 40%, 50%, 60%, 70%, 80%, 90% of bases of a first strand, a second strand, or a combination thereof may comprise a chemical modification. The first strand, the second strand or a combination thereof may comprise one or more sugar modifications. At least about 10%, 20%, 30%, 40%, 50%, 60%, 70%, 80%, 90% of bases of a first strand, a second strand, or a combination thereof may comprise a sugar modification. A sugar modification can comprise a glycosylated base. In some cases, a base of a nucleotide can be glycosylated with a glycan. The first strand, the second strand or a combination thereof may comprise a combination of bases having a chemical modification and a sugar modification.

In some cases, an engineered passenger oligonucleotide as described herein can comprise at least about: 70%, 75%, 80%, 85%, 90%, 95% or more sequence identity to any one of SEQ ID NOs: 6-11, 15-18, 21-23, 26-27, 29, 31, 33, 35, 37, 46-51, 90-99, 155-183, 202-204, 223-224, 234, 244, 444, 454, 464, 466, 838-839, and 900, or any combination thereof. An engineered passenger oligonucleotide as described herein can comprise at least about 5, 10, 15, 20 contiguous bases having at least about: 70%, 75%, 80%, 85%, 90%, 95% or more sequence identity to any one of SEQ ID NOs: 6-11, 15-18, 21-23, 26-27, 29, 31, 33, 35, 37, 46-51, 90-99, 155-183, 202-204, 223-224, 234, 244, 444, 454, 464, 466, 838-839, and 900, or any combination thereof.

In some cases, a second strand can comprise a chemically modified base of a nucleotide. In some cases, a subset of bases of the second strand can be chemically modified, such as from about 1% to about 5% of bases, from about 1% to about 10% of bases, from about 1% to about 20% of bases, from about 1% to about 30% of bases, from about 1% to about 40% of bases, from about 1% to about 50% of bases, from about 1% to about 60% of bases, from about 1% to about 70% of bases, from about 1% to about 80% of bases, or from about 1% to about 90% of bases, or more.

A second strand as described herein can be chemically modified in the same manner as described herein for the engineered oligonucleotide. In some cases, a second strand, when chemically modified, can have at least 90% sequence identity to any one of SEQ ID NOs: 51, 95-99.

A vector can be employed to deliver the engineered oligonucleotide, the nucleic acid construct, or any combination thereof. A vector can comprise DNA, such as double stranded DNA or single stranded DNA. A vector can comprise RNA. In some cases, the RNA can comprise a base modification. The vector can comprise a recombinant vector. The vector can be a vector that is modified from a naturally occurring vector. The vector can comprise at least a portion of a non-naturally occurring vector. Any vector can be utilized. In some cases, the vector can comprise a viral vector, a liposome, a nanoparticle, an exosome, an extracellular vesicle, or any combination thereof. In some cases, a viral vector can comprise an adenoviral vector, an adeno-associated viral vector (AAV), a lentiviral vector, a retroviral vector, a portion of any of these, or any combination thereof. In some cases, a nanoparticle vector can comprise a polymeric-based nanoparticle, an aminolipid based nanoparticle, a metallic nanoparticle (such as gold-based nanoparticle), a portion of any of these, or any combination thereof. In some cases, a vector can comprise an AAV vector. A vector can be modified to include a modified VP1 protein (such as an AAV vector modified to include a VP1 protein). An AAV can comprise a serotype—such as an AAV1 serotype, an AAV2 serotype, AAV3 serotype, an AAV4 serotype, AAV5 serotype, an AAV6 serotype, AAV7 serotype, an AAV8 serotype, an AAV9 serotype, a derivative of any of these, or any combination thereof.

A pharmaceutical composition can comprise the engineered oligonucleotide, the nucleic acid construct, the vector, or any combination thereof. The pharmaceutical composition can further comprise a pharmaceutically acceptable excipient, diluent or carrier. The pharmaceutical composition can be formulated in a unit dose form. The pharmaceutical composition can be formulated with a single active ingredient. The pharmaceutical composition can be encapsulated. The pharmaceutical composition can be formulated as a liquid or as a semi-solid, such as a gel, or a solid. The pharmaceutical composition can be formulated at a solution. The pharmaceutical composition can be formulated as an injectable. The pharmaceutical composition can be formulated as a subdermal implant. The pharmaceutical composition can be implantable. The pharmaceutical composition can be formulated for oral delivery.

A subject in need thereof may be treated for a disease or condition. A treatment may be a pre-treatment, a prophylactic treatment, or a preventive treatment. Treatment may include administration to the subject in need thereof the engineered oligonucleotide, a nucleic acid construct, a vector, or a pharmaceutical composition as described herein. Administration can include delivery via one or more delivery routes, such as oral, otic, ocular, rectal or any combination thereof. Administration can include delivery by an intravenous injection, an intramuscular injection, an intrathecal injection, an intraorbital injection, a subcutaneous injection, or any combination thereof. Treatment may include more than one engineered oligonucleotide delivered in a single dose. Delivery can be concurrent delivery, such as delivery more than one engineered oligonucleotide in a single injection or in two separate injections at the same time. Delivery can be sequential, such as delivery of a first dose and a second dose that can be separated by a period of time, such as minutes, hours, days, weeks, or months.

Treatment can include a second therapy or a co-therapy. In cases of treatment of cancer, a second therapy can include radiation, chemotherapy, an immunotherapy, surgery, or any combination thereof. In cases of treatment of a viral infection, a second therapy can include an immunotherapy, an antiviral, or any combination thereof. In cases of treatment of fibrosis, a second therapy can include a lifestyle change, an organ transplant, an oxygen therapy, an organ rehabilitation, a pharmaceutical composition, or any combination thereof. Administration of a second therapy can be concurrent or sequential, such as separated by a period of time such as minutes, hours, days, weeks, or months.

In some cases, a subject may not have been previously diagnosed with a disease or condition. In some cases, a subject may have been diagnosed with a disease or condition. In some cases, a subject may not have received a definitive diagnosis of a disease or condition. In some cases, a subject may have previously had a disease or condition. A subject may be in remission. A subject may be at risk of developing a disease or condition (such as based at least in part on a previous condition, a lifestyle factor, a genetic variant, or any combination thereof). A subject may have received a diagnostic test. A diagnostic test can include an imaging procedure, a blood count analysis, a tissue pathology analysis, a biomarker analysis, or any combination thereof. In some cases, the disease or condition may be fibrosis or a related condition. In some cases, the disease or condition may be a viral infection, such as a SARS-CoV infection, a SARS-CoV2 infection, a MERS-CoV infection, a CoV-HKU1 infection, an HIV infection, an HCV infection, or any combination thereof. In some cases, the disease or condition may be cancer, such as a head cancer, a neck cancer, skin cancer, a cervical cancer, a prostate cancer, or any combination thereof.

Methods can include in vivo or in vitro delivery methods. Methods can include contacting a cell, such as a cell in vivo with the engineered oligonucleotide, the nucleic acid construct, the vector, or the pharmaceutical composition as described herein. Methods can include contacting a cell, such as an isolated and purified cell (such as a cell in vitro) with the engineered oligonucleotide, the nucleic acid construct, the vector, or the pharmaceutical composition as described herein. Methods can include contacting a tissue, such as an in vivo tissue or an isolated in vitro tissue, with the engineered oligonucleotide, the nucleic acid construct, the vector, or the pharmaceutical composition as described herein.

A kit can include the engineered oligonucleotide in a container, the nucleic acid construct in a container, the vector in a container, the pharmaceutical composition in a container. A kit can include more than one engineered oligonucleotide in a container, more than one vector in a container, more than one nucleic acid construct in a container, or more than one pharmaceutical composition in a container. A kit can include a plurality of containers, each container comprising one or more engineered oligonucleotides, or nucleic acid constructs, or vectors, or pharmaceutical compositions. A kit can include an excipient or a diluent or a buffer or a liquid or gel-like medium for storage of the engineered oligonucleotide, the nucleic acid construct, the vector, or the pharmaceutical composition. A kit can include an excipient or a diluent or a buffer or a liquid or gel-like medium for in vivo delivery to a subject of the engineered oligonucleotide, the nucleic acid construct, the vector, or the pharmaceutical composition. An excipient or diluent or buffer or liquid or gel-like medium can be included in the container housing the engineered oligonucleotide (or nucleic acid construct or vector or pharmaceutical composition) or housed in a separate container. A kit can include a delivery vehicle, such as a syringe or needle. A kit can include one or more reagents for a downstream analysis.

Referring to FIG. 1A-B, this figure shows natural miR-30 guide strand and passenger strand sequences and examples of engineered family members. FIG. 1A shows the sequences of all the natural miR-30 family members found in human (i.e. miR-30a-e-5p) which can have tumor suppressor activity in HNSCC. Sequence variation between the different family members as compared to miR-30a-5p are highlighted in light grey. A guanidine base at position 13 (highlighted in dark gray) represents a non-natural sequence addition comprising a subset of engineered family members that can have benefits over natural sequence for drug development. We have implemented this sequence modification in a subset of oligonucleotides. FIG. 1B shows the sequence of the mature miR-30a-3p passenger strand found in human miR-30a duplex. Listed are examples of non-natural passenger strand sequence (SEQ ID NO: 6 and 46 through 51) which can be used in combination with the guide strands to create, in part, the library of miR-30a mimic duplexes. Changes in sequence from miR-30a-3p are highlighted in grey. The engineered sequence modifications can be implemented to alter duplex structure and biochemical characteristics including stability to nucleases and potency.

Referring to FIG. 2A-C, this figure shows a schematic visualization of guide strand interactions with cognate target sites in 3'UTRs of oncogenic mRNAs. FIG. 2A shows free energy ($\Delta G$) and hybridization between natural miR-30a-5p sequence and target sites in the 3'UTRs of ITGA6, SERPINE1, and EGFR transcripts can be predicted using the software RNA hybrid 2.2. FIG. 2B shows free energy ($\Delta G$) and hybridization between engineered family G007-30 (SEQ ID NO: 39) containing the 'G' insertion at position 13 and the ITGA6, SERPINE1, and EGFR target sites. Note the lower predicted free energy and greater complementarity can infer improved target recognition. FIG. 2C shows that a mimic containing the same 'G' insertion at position 13 as found in G007-30 can demonstrate improved knockdown of select oncogenic targets. M30-021 and M30-037 duplexes are composed of guide strands G039-30 (SEQ ID NO: 68) and G011-30 (SEQ ID NO: 55) respectively and contain the natural miR-30a sequence with certain chemical modifications. M30-040 is composed of engineered guide strand G032-30 (SEQ ID NO: 65) and M30-048 is composed of guide strand G132-30 (SEQ ID NO: 88), both of which have the G007-30 'G' insertion but with different chemical modification patterns. UM-SCC-47 cells were plated in 6-well plates and transfected with 15 nM of the indicated engineered miR-30 mimics for 72 hrs. Following treatment, total RNA was collected from the wells and RT-qPCR was performed to determine expression of ITGA6, SERPINE1, and EGFR. HPRT1 served as an endogenous normalization control and expression levels were normalized to negative control (Neg Con) transfections. In each case, M30-040, with the 'G' insertion, demonstrated greater knockdown of targeted oncogenes than M30-021 and M30-037 (natural guide strand sequence) and demonstrated as good or greater knockdown of targeted oncogenes than M30-048, which also has the 'G' insertion.

Figure 3:
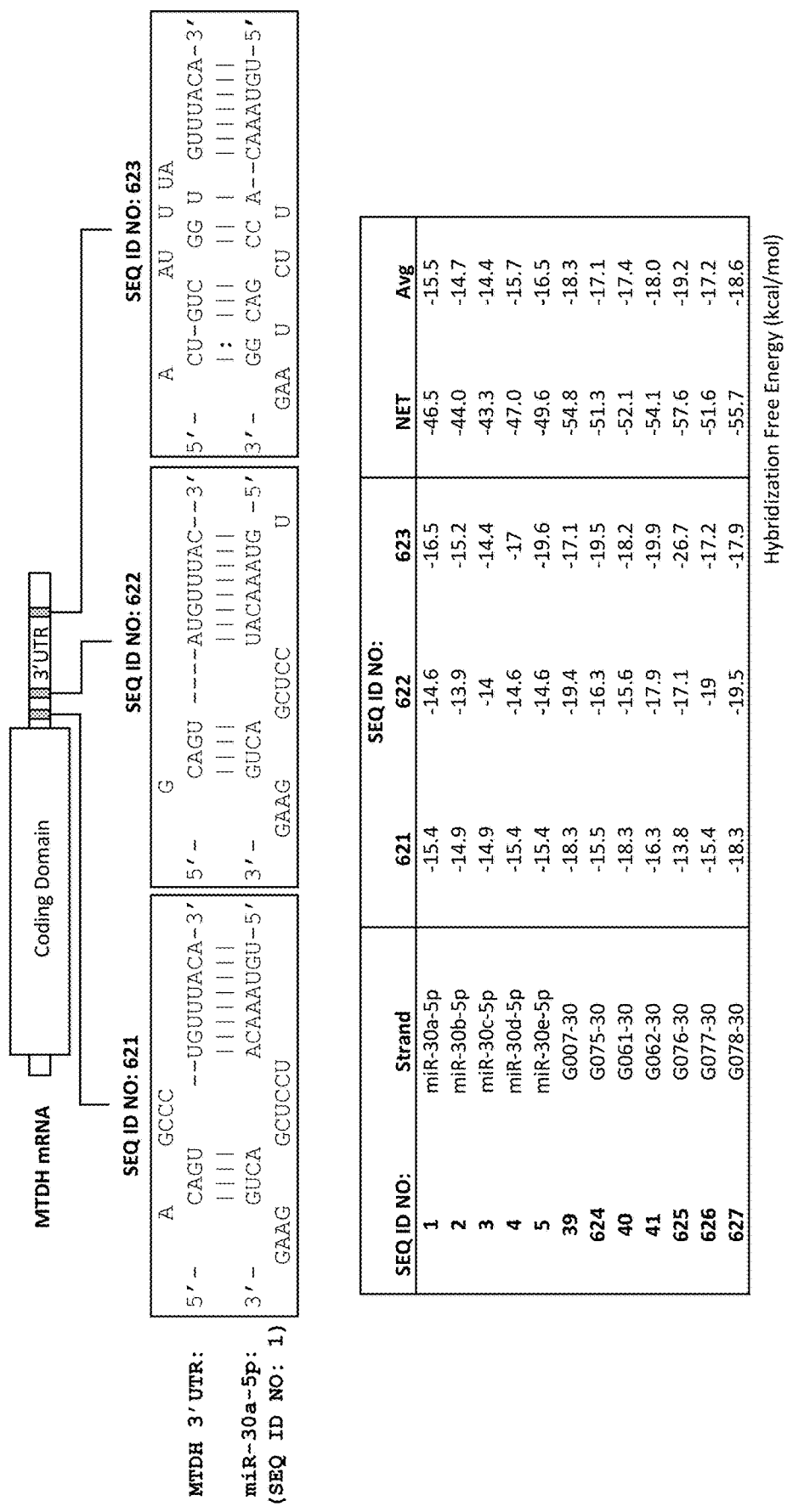
FIG. 3 shows a schematic visualization of miR-30-5p target sites in the MTDH 3'UTR.

Referring to FIG. 3, this figure shows a schematic visualization of miR-30-5p target sites in the MTDH 3'UTR. Shown is an illustration of the MTDH mRNA including its coding domain and three experimentally-validated miR-30-5p target sites (indicated in grey) within its 3'UTR. Hybridization between natural miR-30a-5p and the MTDH target sites, as well as calculated free energy ($\Delta G$) for miR-30-5p and all the indicated engineered guide strands were calculated using the software RNAhybrid 2.2 (https://bibiserv.cebitec.uni-bielefeld.de/rnahybrid). Net sum of free energy across all three target sites (NET) and their averaged $\Delta G$ (Avg.) is also indicated. Note all artificial guide strands have lower calculated net and averaged free energy for hybridization than natural miR-30-5p family members inferring improved target recognition.

Referring to Table 8, this table shows calculated free energy requirements for target recognition of natural and mimic miR-30 family guide strands to 3' UTR sites in EGFR, IGF1R, MET and IRS1 gene transcripts. miR-30 mimic exemplary guide strand constructs are indicated include G007-30 (SEQ ID NO: 39) and G064-30 (SEQ ID NO: 43) that have predicted improved base pairing and lower G targeting of these oncogenes.

TABLE 8

Calculated Free Energy Requirements for Target Recognition of Mimic Guide Strands to miR-30 Downstream Transcript

| SEQ ID NO: | Guide Strand | Free energy ($\Delta G$)* [kcal/mol] | | | |
|---|---|---|---|---|---|
| | | EGFR | IGF1R | MET | IRS1 |
| 1 | miR-30a-5p | −15.0 | −16.4 | −10.6 | −19.8 |
| 2 | miR-30b-5p | −13.6 | −17.0 | −11.6 | −13.6 |
| 3 | miR-30c-5b | −11.8 | −17.0 | −11.6 | −13.6 |
| 4 | miR-30d-5p | −14.8 | −14.9 | −10.6 | −19.8 |
| 5 | miR-30e-5p | −15.8 | −16.4 | −11.6 | −19.8 |
| 628 | G079-30 | −15.5 | −16.5 | −10.6 | −21.0 |
| 629 | G080-30 | −15.2 | −15.3 | −10.6 | −14.0 |
| 630 | G081-30 | −14.2 | −15.3 | −10.6 | −14.0 |
| 631 | G082-30 | −13.6 | −15.3 | −10.6 | −13.0 |
| 632 | G083-30 | −12.3 | −15.3 | −10.6 | −13.0 |
| 633 | G084-30 | −13.7 | −13.9 | −10.8 | −12.1 |
| 634 | G085-30 | −11.8 | −13.9 | −10.8 | −12.1 |
| 635 | G086-30 | −13.6 | −13.9 | −10.6 | −12.1 |
| 636 | G087-30 | −11.8 | −13.9 | −10.6 | −12.1 |
| 39 | G007-30 | −18.1 | −17.4 | −10.6 | −21.1 |
| 624 | G075-30 | −14.1 | −18.0 | −14.1 | −17.9 |
| 44 | G065-30 | −13.0 | −18.0 | −14.1 | −17.8 |
| 40 | G061-30 | −16.4 | −14.5 | −10.6 | −19.4 |
| 41 | G062-30 | −17.1 | −17.4 | −12.4 | −21.1 |
| 42 | G063-30 | −16.2 | −16.4 | −11.0 | −19.4 |
| 637 | G088-30 | −18.5 | −16.7 | −10.6 | −16.1 |
| 638 | G089-30 | −13.0 | −17.2 | −10.6 | −17.3 |
| 639 | G090-30 | −17.3 | −18.2 | −10.6 | −18.8 |
| 640 | G091-30 | −13.4 | −15.6 | −11.1 | −21.6 |
| 626 | G077-30 | −19.6 | −17.2 | −10.6 | −18.7 |
| 627 | G078-30 | −19.8 | −16.7 | −10.6 | −18.3 |
| 641 | G092-30 | −16.1 | −17.3 | −10.6 | −21.4 |
| 642 | G093-30 | −19.3 | −17.5 | −10.6 | −21.0 |

*Free energy ($\Delta G$) was calculated using RNAhybrid 2.2 between the indicated mimic guide strand sequences and target sites in the 3'UTRs of EGFR (SEQ ID NO: 469), IGF1R (SEQ ID NO: 832), MET (SEQ ID NO: 833), and IRS2 (SEQ ID NO: 834) gene transcripts. Lower predicted free energy ($\Delta G$) infers improved target recognition.

Figure 4A:
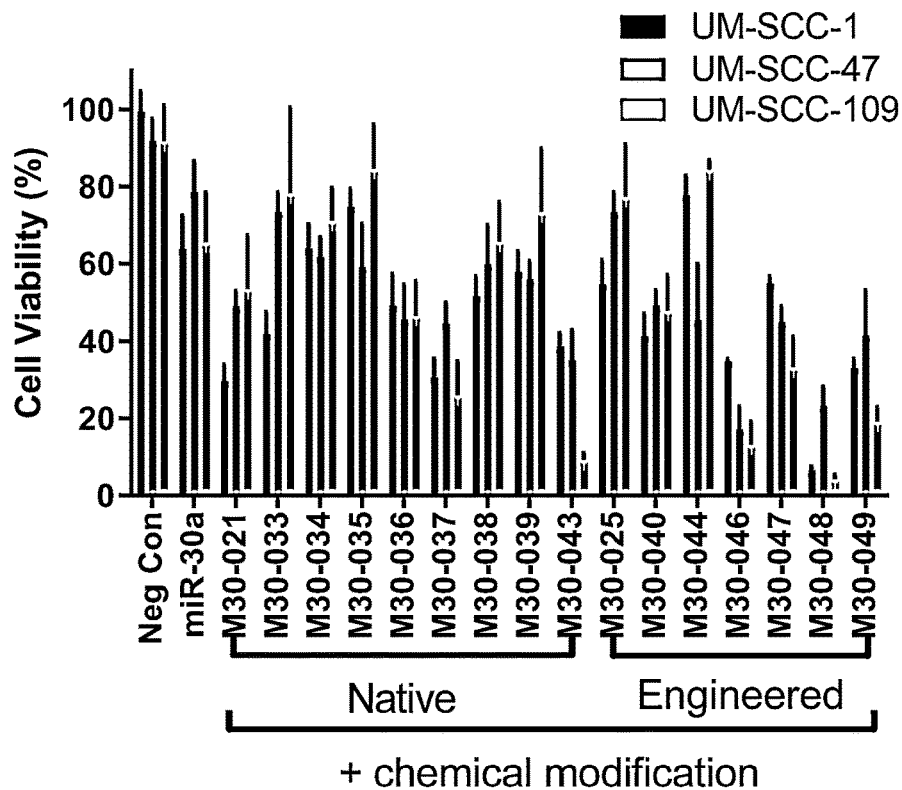
FIG. 4A shows anti-tumor activity of miR-30 mimics in cancer cell lines.
Figure 4B:
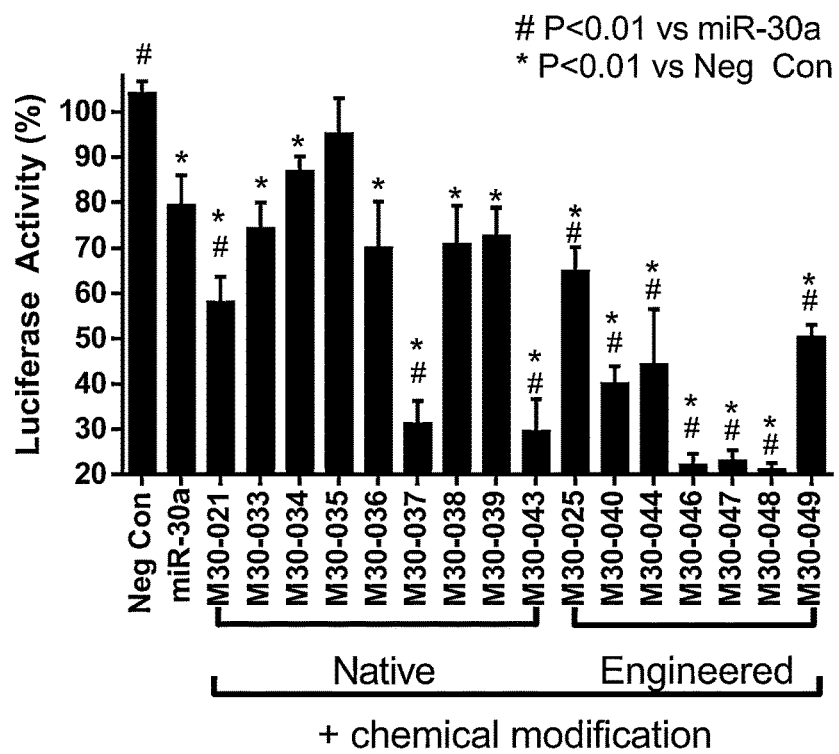
FIG. 4B shows knock-down of a luciferase reporter containing cancer-relevant miR-30 target sites with its 3' UTR by miR-30 mimics.
Figure 4C:
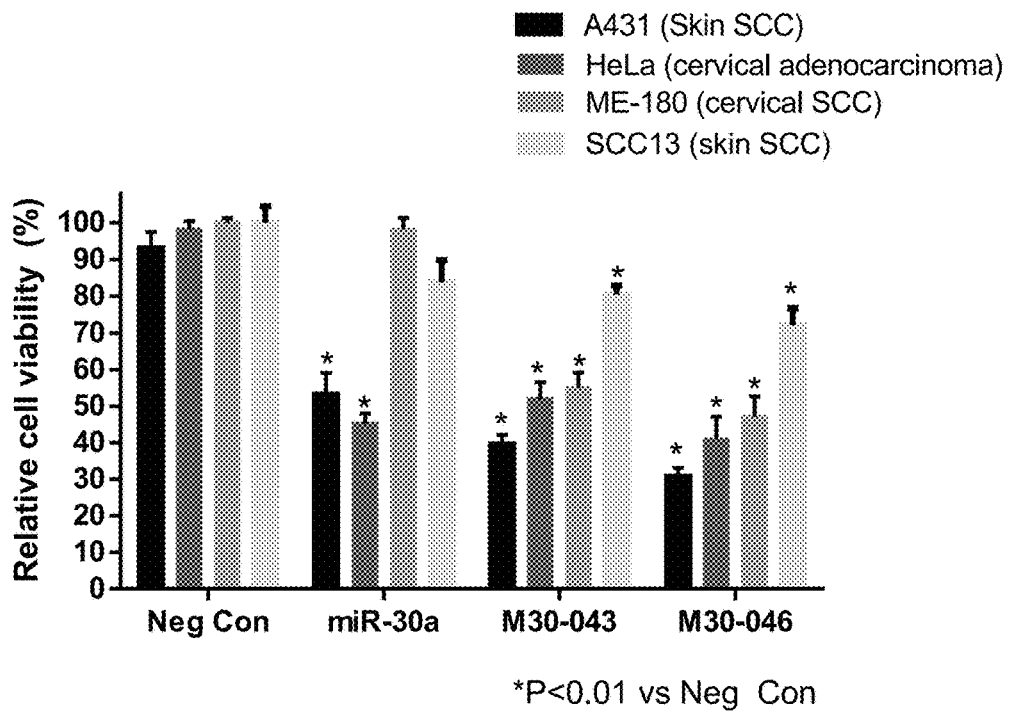
FIG. 4C shows the anti-tumor activity of native miR-30a and exemplar engineered mimics in additional cell lines with different genetic backgrounds.
Figure 4D:
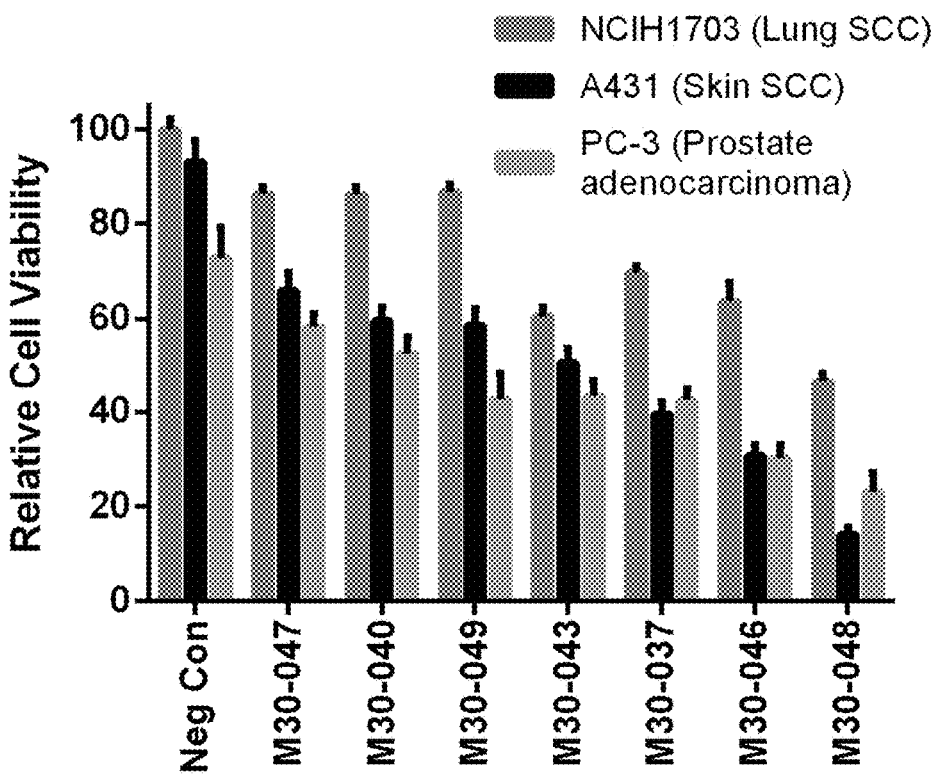
FIG. 4D shows anti-tumor activity of a panel of engineered miR-30 mimics in additional cancel cell lines with different histology and genetic backgrounds.

Referring to FIG. 4A-D, this figure shows that engineered oligonucleotides hybridized to form novel miR-30-5p mimics can have equivalent or improved anti-tumor activity in cancer cell lines. FIG. 4A shows UM-SCC-1, UM-SCC-47, and UM-SCC-109 cells were plated in 96-well plates and were transfected with 15 nM mimics using RNAimax agent 6 hours after plating for 5 days. Following treatment, cell viability was assessed by XTT assay. All data represent the mean±SEM relative to cells treated in absence of mimic (designated as 100% viability). All mimics can have unique patterns of chemical modifications and can have one of the modified passenger strands. Mimics are separated based on guide sequence including either miR-30a-5p (Native) or miR-G-30-5p derivatives (Engineered). Anti-tumor activity for each mimic can be statistically ($P<0.05$) an improvement in reducing cell viability or equivalent to natural miR-30a duplex in each cell line. FIG. 4B shows luciferase activity following treatments in a subline of UM-SCC-1 (UM-SCC-1$^{luc}$) genetically engineered to overexpress a luciferase reporter containing cancer-relevant miR-30 target sites within its 3' untranslated region (UTR). UM-SCC-1$^{luc}$ cells were plated in 96-well plates and transfected with 15 nM mimics using RNAimax agent 6 hrs after plating for 3 days before cell lysis and luciferase assay. FIG. 4C displays the anti-tumor activity of native miR-30a and exemplar engineered mimics, M30-043 and M30-046, in additional cell lines with different genetic backgrounds. Indicated cancer cell lines were plated in 96-well plates and were transfected with 25 nM mimics using RNAimax agent 6 hrs after plating for 5 days. Following treatment, cell viability was assessed by XTT assay. Statistical significance (P<0.01) compared to Neg Con treatment is indicated. FIG. 4D displays further anti-tumor activity of a panel of engineered miR-30 mimics in additional cancel cell lines with different histology and genetic backgrounds. Indicated cancer cell lines were plated in 96-well plates and were transfected with 25 nM mimics using RNAimax agent 6 hrs after plating for 5 days. Following treatment, cell viability was assessed by XTT assay. Statistical significance (P<0.01) compared to Neg Con treatment is indicated. All data represent the mean±SEM from a minimum three independent experiments.

Figure 5A:
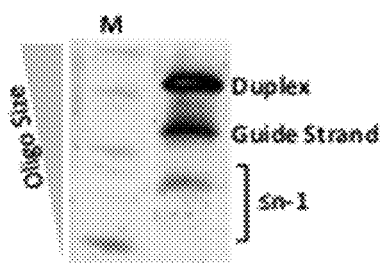
FIG. 5A shows an example of Urea-PAGE resolving a nucleic acid marker (M) and sample comprising mimic duplex, guide strand, and degraded fragments (≤n−1)
Figure 5B:
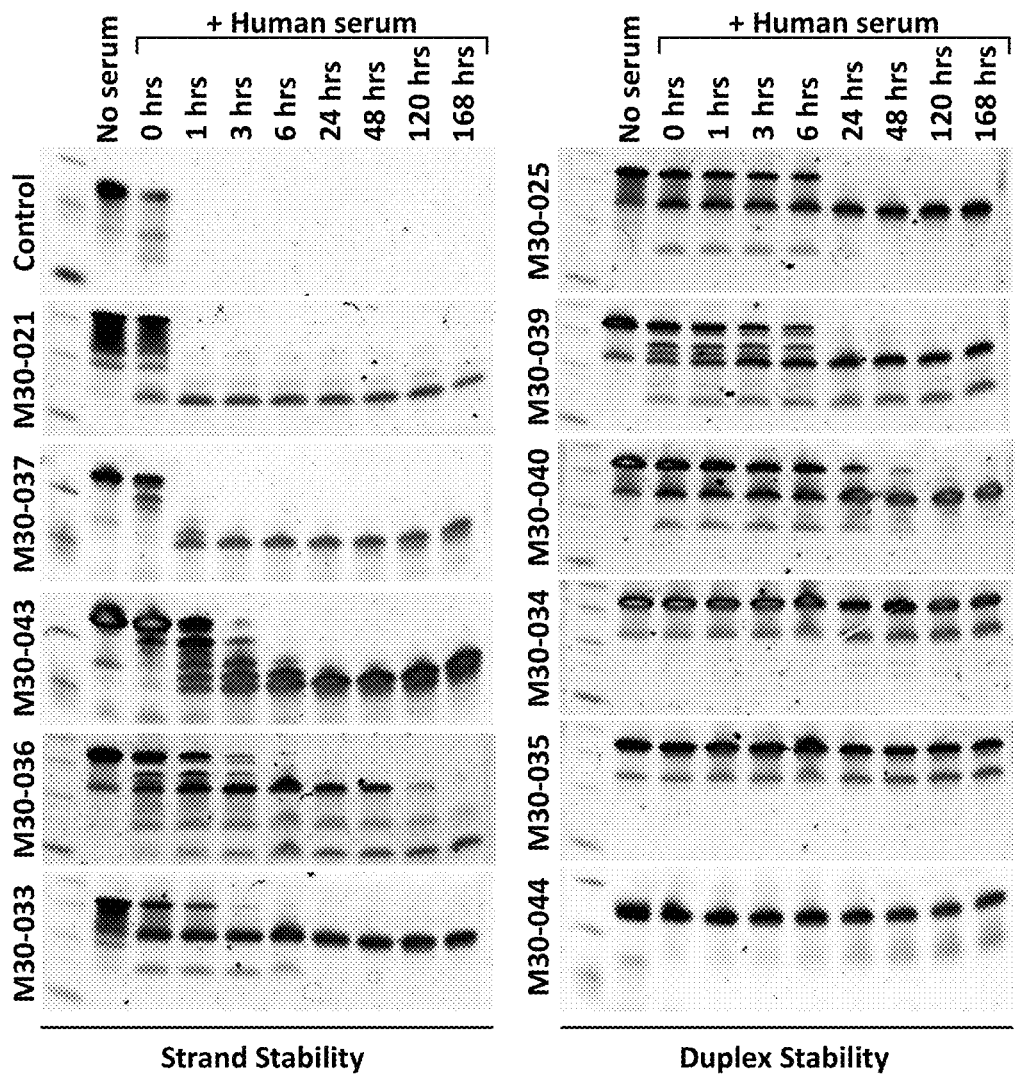
FIG. 5B shows duplex stability of engineered miR-30 miRNA mimics in human serum.

Referring to FIG. 5A-B, this figure shows chemical modifications and structural modifications of engineered mimic duplexes can improve guide strand and duplex stability to biological nucleases. FIG. 5A shows an example of Urea-PAGE resolving a nucleic acid marker (M) and sample comprising mimic duplex, guide strand, and degraded fragments (≤n−1). FIG. 5B shows engineered 10 uM miR-30-5p mimics were incubated in 10% human sera at 37° C. for the indicated lengths of time. Duplex stability at each time point was visualized by denaturing Urea-PAGE. An exceptional example displays that removal of the single nucleotide internal bulge in M30-040 stabilized the M30-044 mimic duplex to biological nucleases out to 7 days (168 hrs).

Figures 6A, 6B:
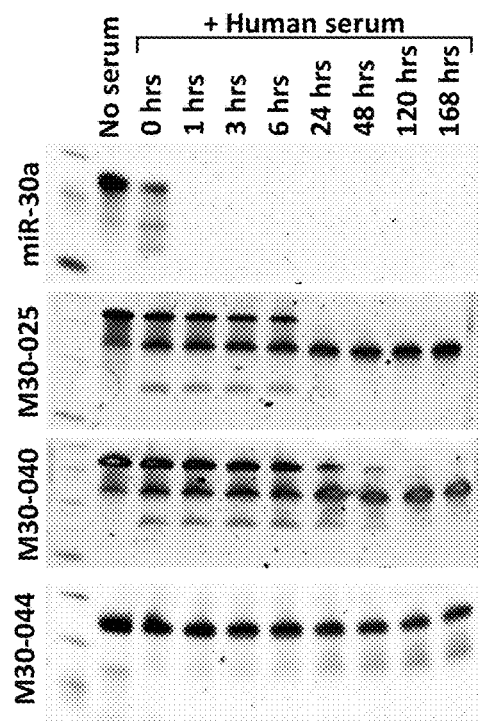
FIG. 6A shows structure of engineered mimic duplexes with passenger strands sequence and chemical modifications which alter the mimic structure.
FIG. 6B shows exemplar duplex stability of engineered miR-30 miRNA mimics in human serum.

Referring to FIG. 6A-B, this figure shows that modification of mimic sequence and structure can improve stability. FIG. 6A shows engineered mimics; M30-025, M30-040, and M30-044; which have the identical highly stable engineered guide strand, G032-30 (SEQ ID NO: 65) in duplex with passenger strands with sequence and chemical modifications which alter the mimic structure. Indicated is the design schematic towards M30-044 incorporating design features that can further enhance mimic stability. Bases in bold contain 2'-O-methyl modifications, lower case bases have 2'-fluoro substitutions, 'ps' signifies phosphothioate backbone and (Amino C6) indicates addition of an amino-carbon 6 chain. FIG. 6B shows mimics were incubated in 10% human sera at 37° C. for the indicated lengths of time. Duplex stability at each time point was visualized by denaturing Urea-PAGE. Mimics with enhanced stability can be preferred for use with conjugation-based delivery systems in which the mimic can be directly exposed to nucleases in biological fluids and the delivery does not provide any additional shielding benefit. M30-040 displays superior anti-tumor activity compared to M30-025 or M30-044 as previously demonstrated in FIG. 4B.

Referring to FIG. 7A-C, this figure shows the effect of sequence changes on the mimic structure and activity. FIG. 7A displays the sequences of mimics; M30-033, M30-034, and M30-040. All guide strands have similar chemical modifications (not shown). The same is true for the passenger strands. M30-033 and M30-034 are comprised of the highly stable guide strand G042-30 (SEQ ID NO: 69) which contains the natural miR-30a-5p guide sequence. M30-040 is comprised of G032-30 (SEQ ID NO: 65) which has identical chemical modifications to G042-30 but has an inserted 'G' at position 13 (highlighted in grey). M30-033 retains a similar structure as M30-040 (i.e. internal bulge) and M30-034 has the same passenger strand as M30-040. FIG. 7B shows a panel of 6 HNSCC cell lines that were transfected with M30-033, M30-034, M30-040, or a negative control (Neg Con) at 15 nM for 5 days as described above. Cell viability was assessed by XTT assay. Mock treatments were transfected in the absence of mimic. All data represent the mean±SEM from three independent experiments. Statistical improvement (P<0.01) in M30-040 reduction in cell viability compared to M30-033 (*) and M30-043 (#) were determined by a two-way t-test. FIG. 7C shows luciferase activity following 15 nM treatments of UM-SCC-1$^{luc}$ genetically engineered to overexpress a luciferase reporter containing miR-30 target sites within its 3'UTR. All data represent the mean±SEM from three independent experiments. Collectively, M30-040 demonstrates a greater reduction in cell viability and luciferase knockdown activity.

Figure 8A:
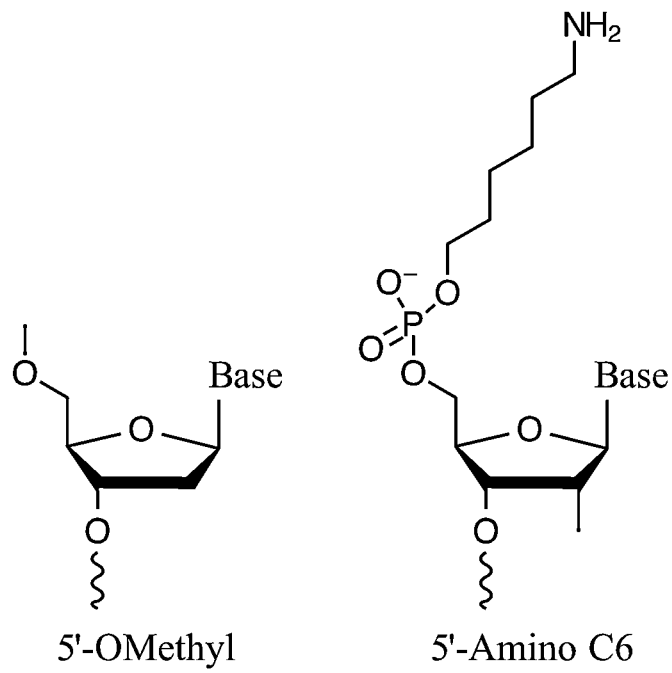
FIG. 8A shows the structure of two blunting modifications that can be made to the 5' terminus of the guide strand.
Figure 8B:
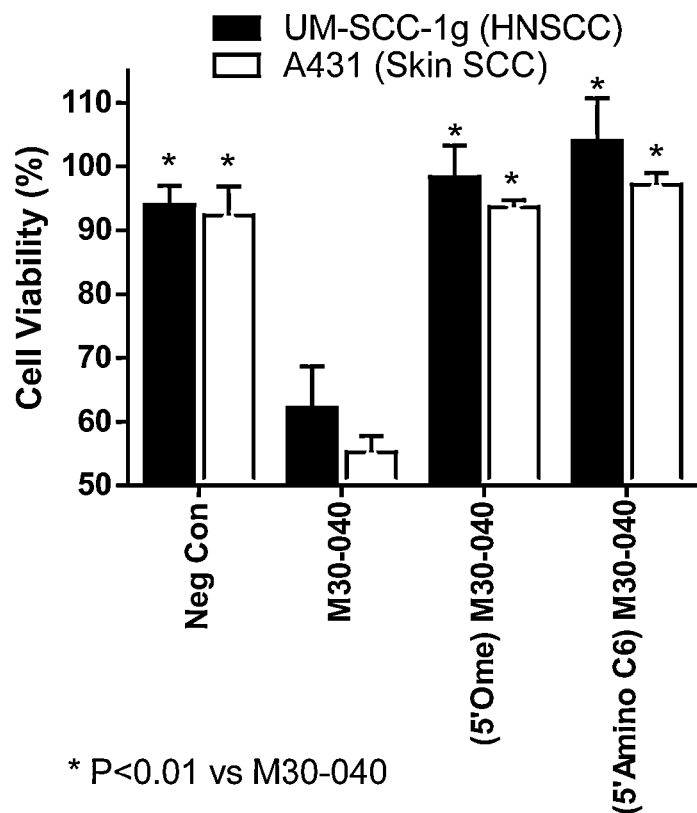
FIG. 8B shows blunted anti-tumor activity of mimics with 5' modified guide strands.

Referring to FIG. 8A-B, this figure shows anti-tumor activity of miR-30 mimic, M30-040, is dependent on guide strand incorporation into RNA-induced Silencing Complex (RISC). FIG. 8A shows the structure of two modifications that can be made to the 5' terminus of the guide strand. In this experiment, two variants of M30-040 were synthesized with either a 5'-terminal methyl group (5'-OMethyl) or amino-carbon 6 chain (5'-Amino C6) modification of the guide strand, referred to as mimics 5'OMe M30-040 and 5'Amino C6 M30-040, respectively. Chemical modification of the 5'-hydroxyl terminus in guide strands can attenuate activity at least in context to siRNA duplexes by blocking intracellular phosphorylation and subsequent recognition by the RISC effector. FIG. 8B shows UM-SCC-1 and A431 cancer cells treated with each mimic at 15 nM and cell viability was assessed by XTT assay on day 5 as described above. Both 5'-terminal modifications interfere with anti-cancer cell activity of M30-040 in vitro.

Figure 9A:
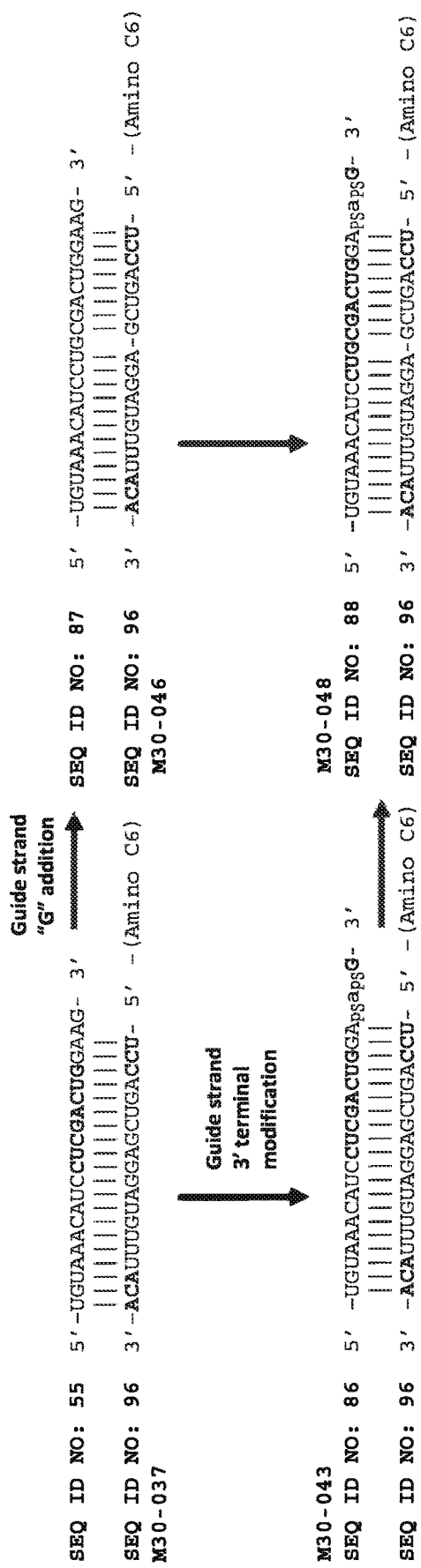
FIG. 9A shows structure of exemplar engineered miR-30 mimic duplexes.
Figure 9C:
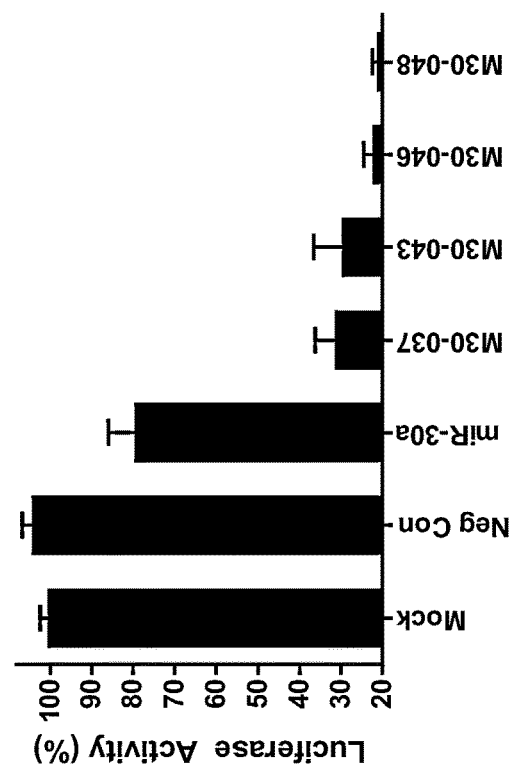
FIG. 9C shows knock-down of a luciferase reporter by exemplar engineered miR-30 mimics with varied structure but identical guide strands.
Figure 9B:
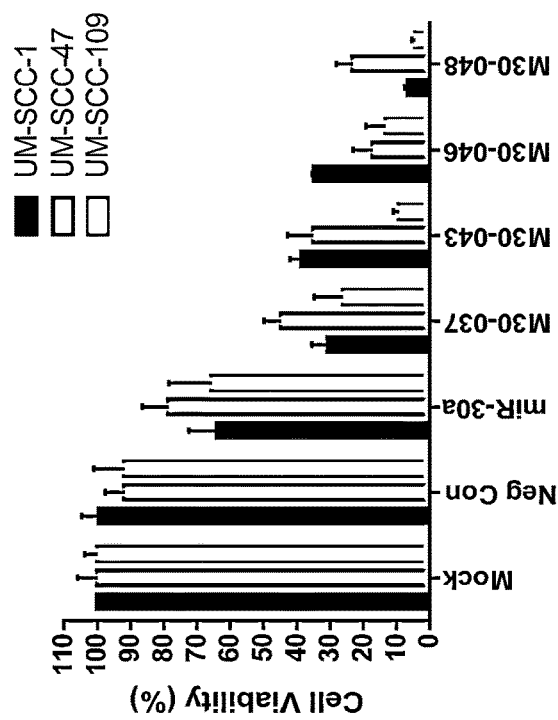
FIG. 9B shows anti-tumor activity of exemplar engineered miR-30 mimics in cancer cell lines.

Referring to FIG. 9A-C, this figure shows an example development path of an engineered miR-30 mimic with improved activity. In FIG. 9A, the sequence and structure of mimics M30-037 and M30-043 are composed of guide strands G011-30 (SEQ ID NO: 55) and G129-30 (SEQ ID NO: 86) respectively and contain the natural miR-30a sequence with the chemical modifications as shown. Sequence and structures are also displayed for engineered mimics M30-046 and M30-048 which are composed of guide strand G130-30 (SEQ ID NO: 87) and G132-30 (SEQ ID NO: 88) respectively and contain an engineered sequence. Its chemical modification pattern was designed to retain poly-targeting activity of downstream transcripts. Indicated is the design schematic towards M30-048 incorporating an accumulation of features leading to improved activity, including a 3' terminal modification pattern and mimic bulge structure. Bases in bold contain 2'-O-Methyl modifications, lower case bases have 2'-fluoro substitutions, 'ps' signifies phosphothioate backbone and (Amino C6) indicates addition of an amino-carbon 6 chain. FIG. 9B displays anti-tumor activity in a panel of cancer cell lines transfected with the indicated mimics or a negative control (Neg Con) at 15 nM for 5 days. Cell viability was assessed by XTT assay. Mock treatments were transfected in the absence of mimic. All data represent the mean±SEM of at least three independent experiments. FIG. 9C displays luciferase activity following 15 nM treatments of UM-SCC- $1^{luc}$ as described above. All data represent the mean±SEM from three independent experiments.

Figure 10A:
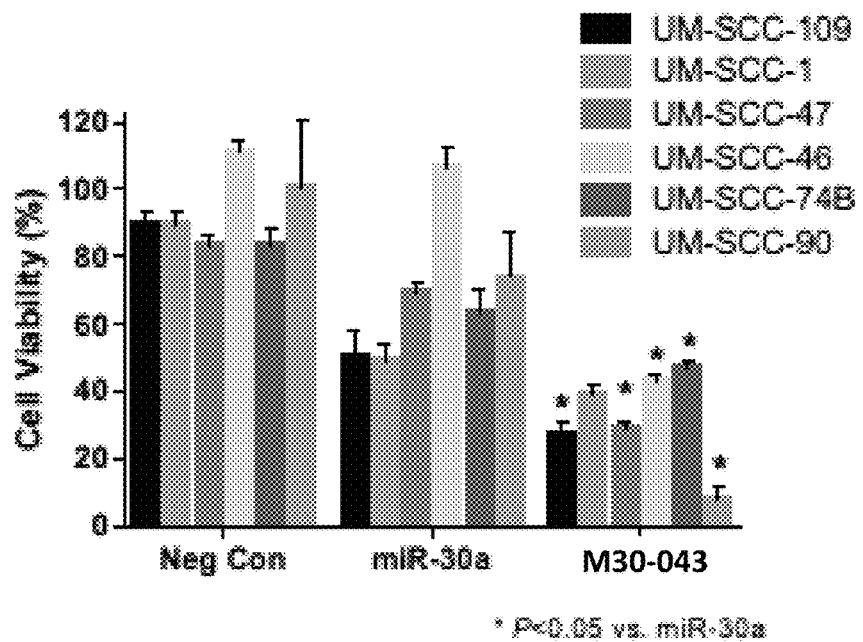
FIG. 10A displays improved anticancer activity and silencing of exemplar engineered mimic M30-043.
Figure 10B:
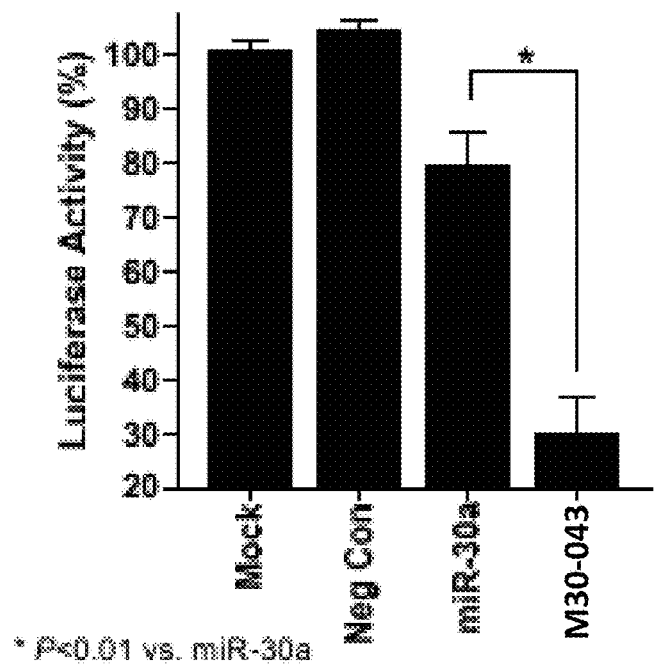
FIG. 10B shows knockdown of luciferase activity by exemplar engineered mimic M30-043.

Referring to FIG. 10A-B, FIG. 10A displays improved anticancer activity and silencing of engineered mimic M30-043 which is composed of guide strand G129-30 (SEQ ID NO: 86) which is a miR-30 mimic containing the natural miR-30a sequence with chemical modifications. Compared to unmodified, natural miR-30a, M30-043 has improved activity on cell viability at 7.5 nM in a panel of 7 HNSCC cell lines in vitro. Statistical significance (P<0.05) compared to miR-30a treatment is indicated. FIG. 10B shows luciferase activity following 15 nM treatments in a subline of UM-SCC-1 (UM-SCC-$1^{luc}$) genetically engineered to overexpress a luciferase reporter containing miR-30 target sites within its 3'UTR. Mock samples were transfected in the absence of API. All data represent the mean±SEM from three independent experiments.

Figure 11A:
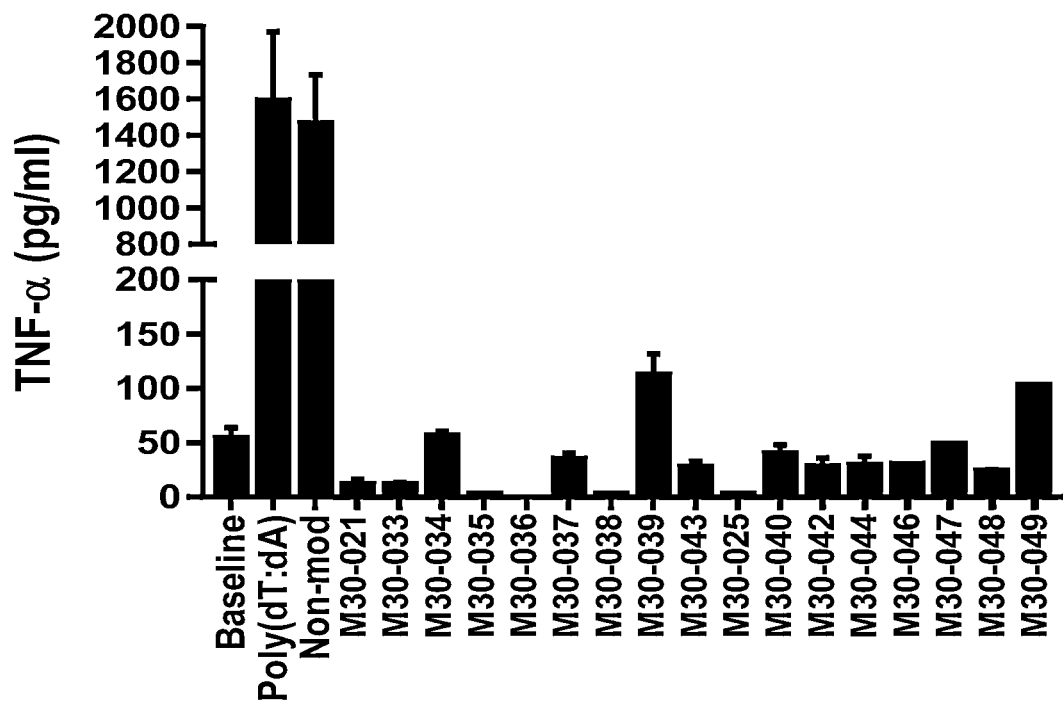
FIG. 11A shows reductions in innate TNFα production after exposure of PBMCs to engineered miR-30 mimics
Figure 11B:
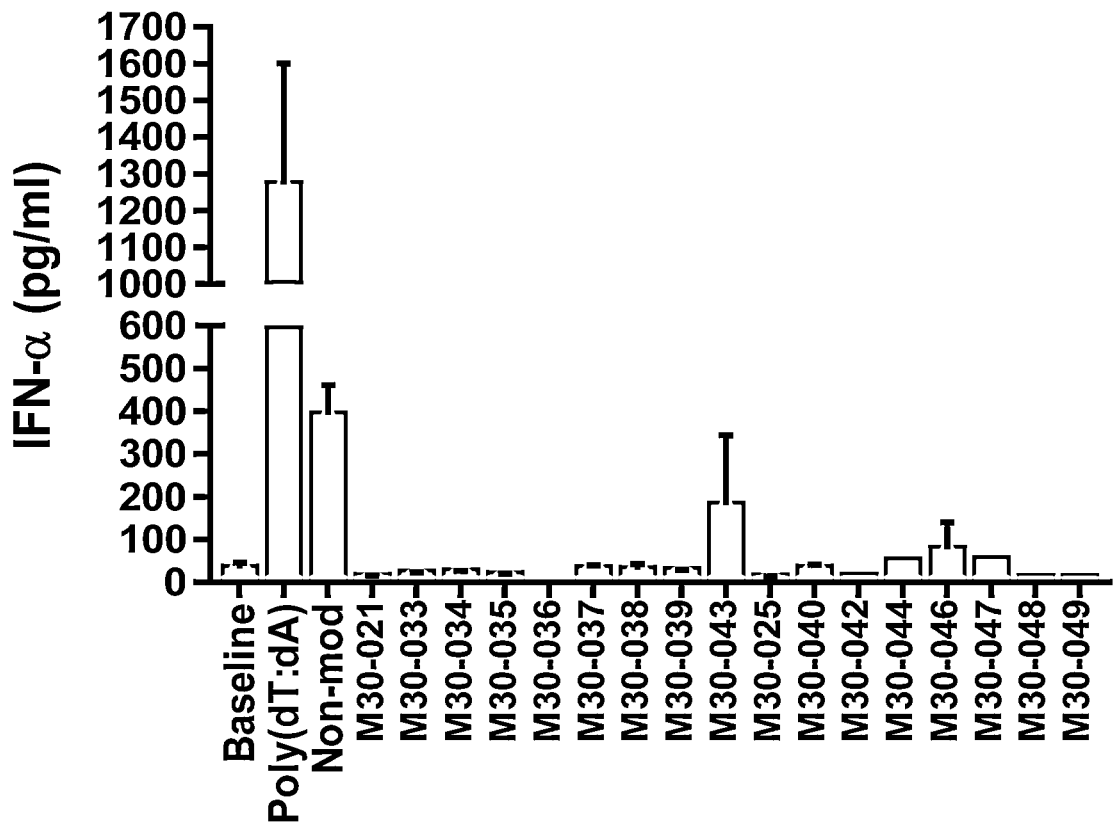
FIG. 11B shows reductions in innate IFNα production after exposure of PBMCs to engineered miR-30 mimics.

Referring to FIG. 11A-B, this figure displays reductions in innate immunostimulation for engineered miR-30 mimics. Human Peripheral Blood Mononuclear Cells (PBMCs) (~2-6×10$^5$ cells) were plated in round bottom 96 well plates and transfected at 133 nM concentrations of the indicated mimics for 48 hours with RNAiMAX reagent. Levels of TNF-α (FIG. 11A) and IFN-α (FIG. 11B) in supernatant media were quantified by ELISA. Poly (dA:dT) oligonucleotide served as a positive control for immunostimulation. Transfection with a non-chemically modified RNA duplex (Non-mod) demonstrated potential of mimic immunostimulation. Cells treated in the absence of mimic served to establish baseline.

Referring to FIG. 12A-D, this figure displays sensitization of cancer cells to approved treatments, cisplatin and cetuximab, when treated with engineered mimic, M30-040, in combination in vitro. FIG. 12A shows UM-SCC-1 and -46 cancer cells were cultured in the presence of escalating micro-doses of cisplatin for ≥3 months to create sublines resistant to cisplatin. Dose response curves evaluating cytotoxicity demonstrated enhanced resistance to cisplatin compared to parental cell lines. FIG. 12B shows parental and cisplatin-resistant cell lines were transfected with 15 nM M30-040 or nonspecific control mimic (Neg Con) for 5 days as described above. Relative cell number was quantified by XTT. Data is normalized to mock transfection treatments. FIG. 12C shows combination treatment of parental UM-SCC-1 and -46 cells transfected with M30-040 at 15 nM for 48 h and then subsequently treated with cisplatin at their respective IC50 concentrations (Cis IC50). Relative cell number was quantified by XTT at day 5 post-transfection. FIG. 12D shows another cancer cell line, UM-SCC-47, were transfected with 15 nM M30-040 for 48 h and subsequently treated with the indicated concentrations of cetuximab. M30-040 pre-treatment may have sensitized UM-SCC-47 cells to cetuximab.

Figure 13A:
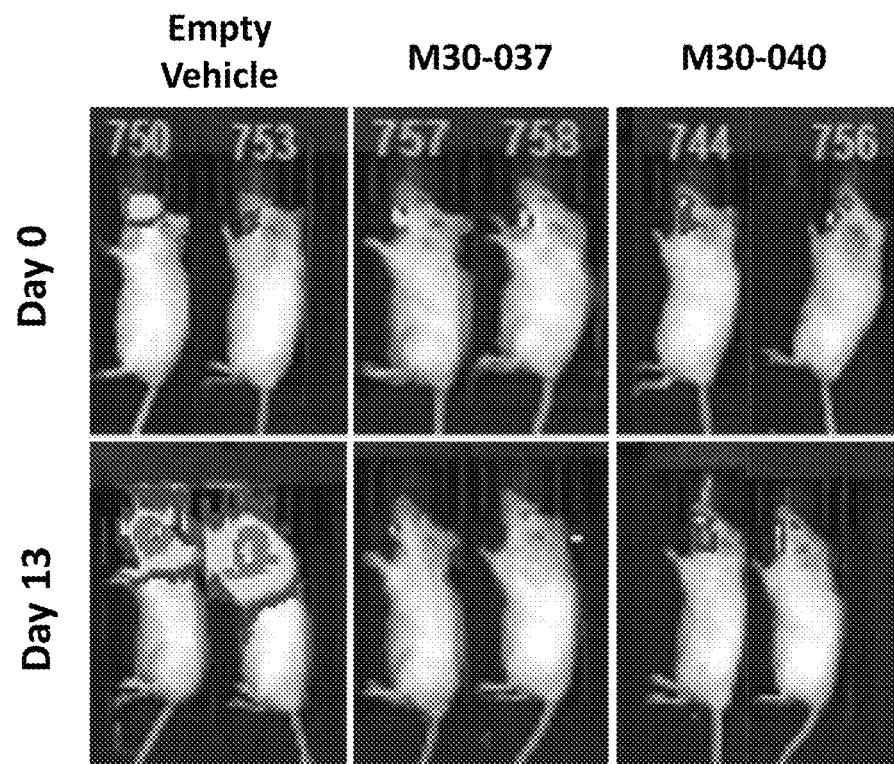
FIG. 13A shows luciferase images of anti-tumor activity in orthotopic HNSCC tumors by engineered miR-30 mimics.
Figure 13B:
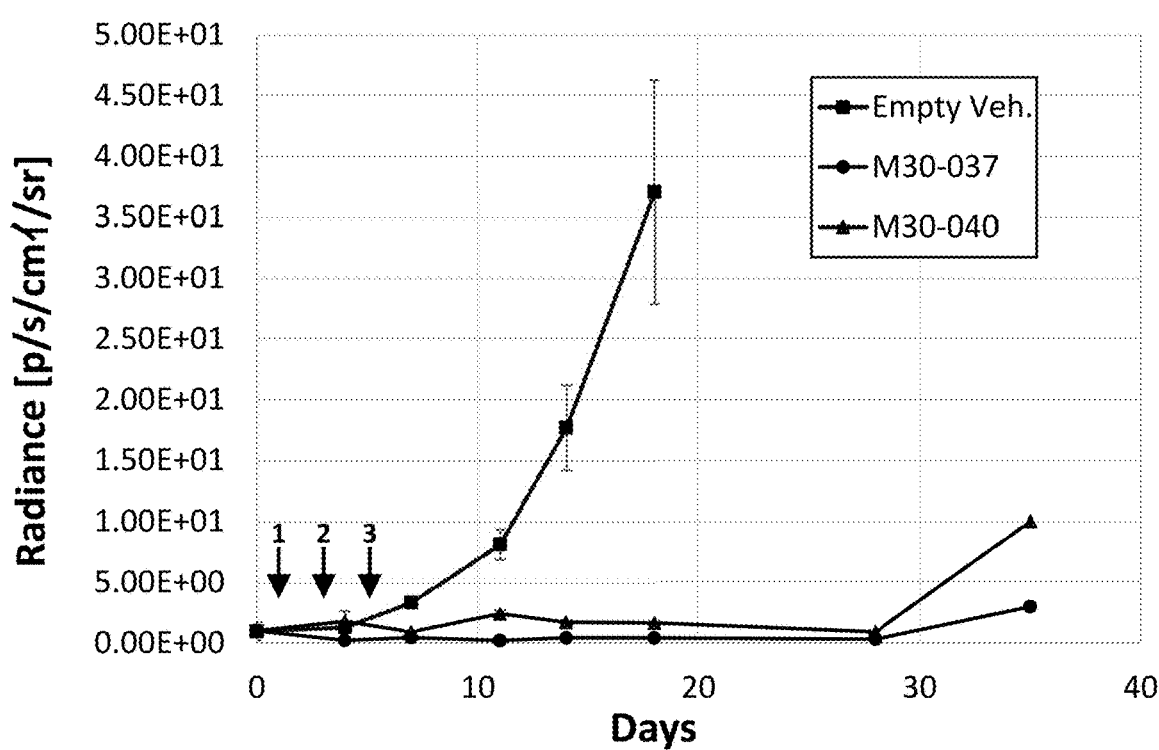
FIG. 13B shows quantification of luciferase activity in orthotopic HNSCC tumors by engineered miR-30 mimics.
Figure 13C:
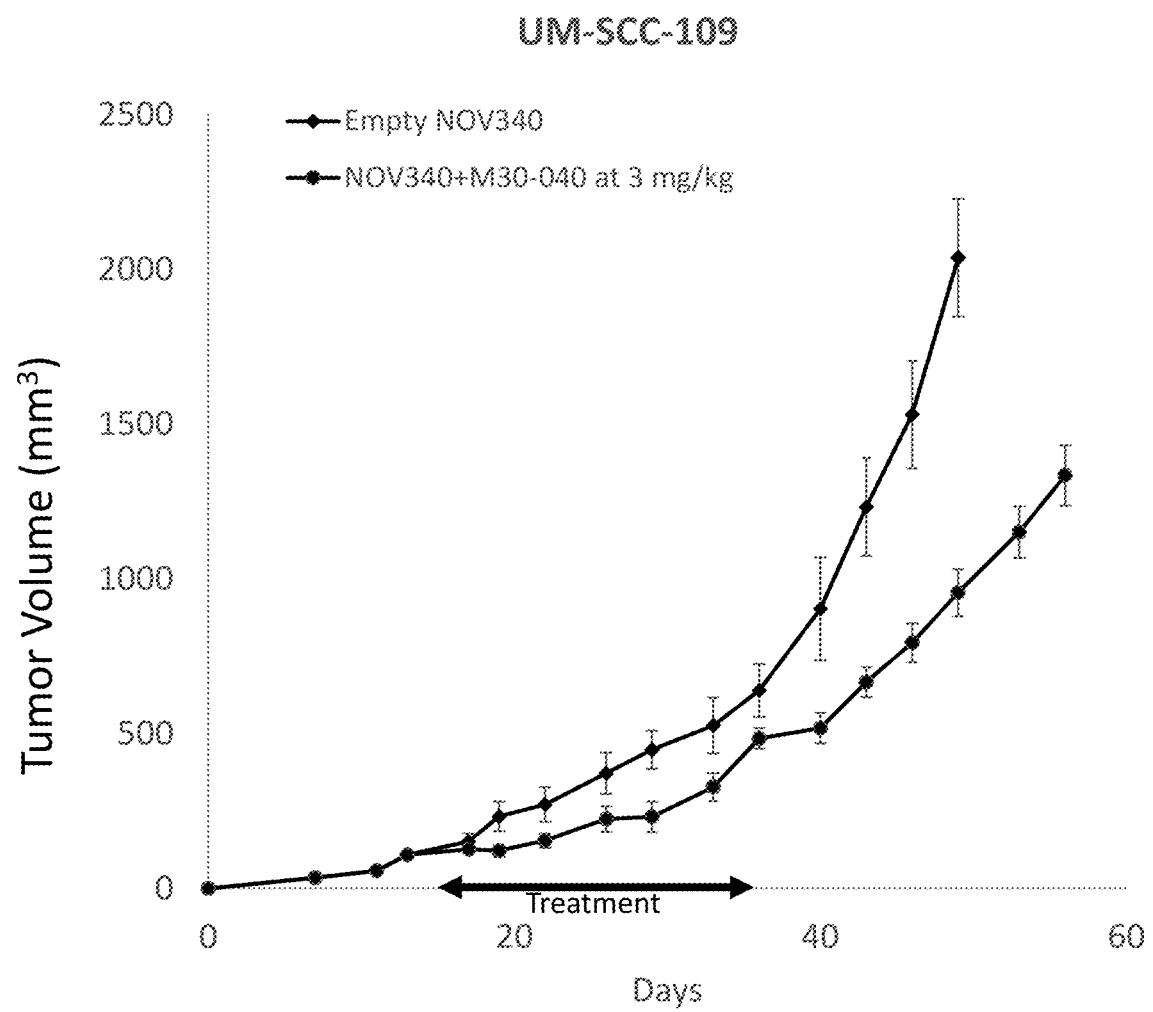
FIG. 13C shows anti-tumor activity of engineered miR-30 mimic M30-040 in a subcutaneous HNSCC mouse model.

Referring to FIG. 13A-C, this figure shows anti-tumor activity in orthotopic HNSCC tumors. FIG. 13A shows female SCID mice were implanted with UM-SCC-$1^{Luc}$ subline in floor-of-mouth on the left side of their oral cavity. 14 days after tumor implantation, bioluminescence was monitored in live animals using In Vivo Imaging System (IVIS) by dosing with D-luciferin at 150 mg/kg via IP injection. Animals were treated by intravenous injection (IV) with 3 doses BIW at 3 mg/kg with NOV340 (PMID: 24832107) LNP-formulated mimics M30-037 and M30-040 or Empty NOV340 LNP control. Images show tumor bioluminescence from a pair of anesthetized animals in each treatment group at day 0 prior to first dose and day 13 of the study. FIG. 13B shows bioluminescence was quantified for each animal at the indicated time points and mean radiance±SEM was plotted to generate tumor growth curves. Indicated are the 3 sequential BIW doses of formulated mimic. FIG. 13C female SCID mice were implanted with UM-SCC-109 tumors on the right flank, grown to ~150 mm3, and subsequently treated by intravenous injection (IV) at 3 mg/kg with NOV340 formulated M30-040 or Empty NOV340 LNP control for 6 doses on a BIW schedule. Tumor growth curves were plotted by calculating tumor volume at each time point. A significant growth delay was observed with M30-040 treatment.

Figure 14A:
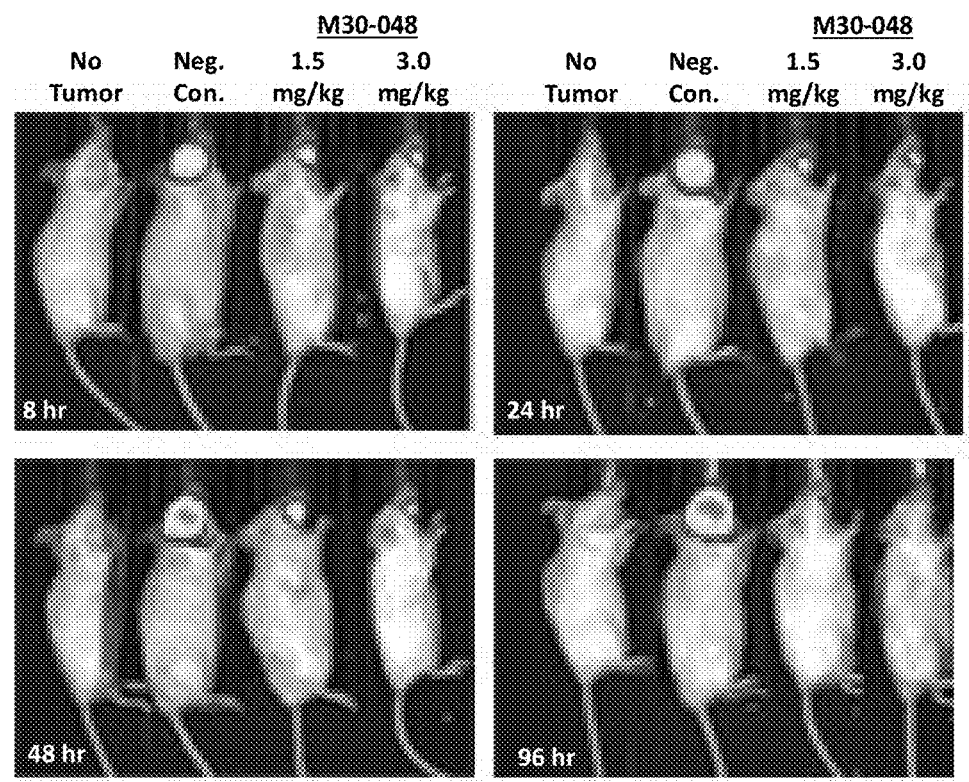
FIG. 14A shows luciferase images of anti-tumor activity in orthotopic HNSCC tumors by engineered miR-30 mimic M30-048 with local treatment.
Figure 14B:
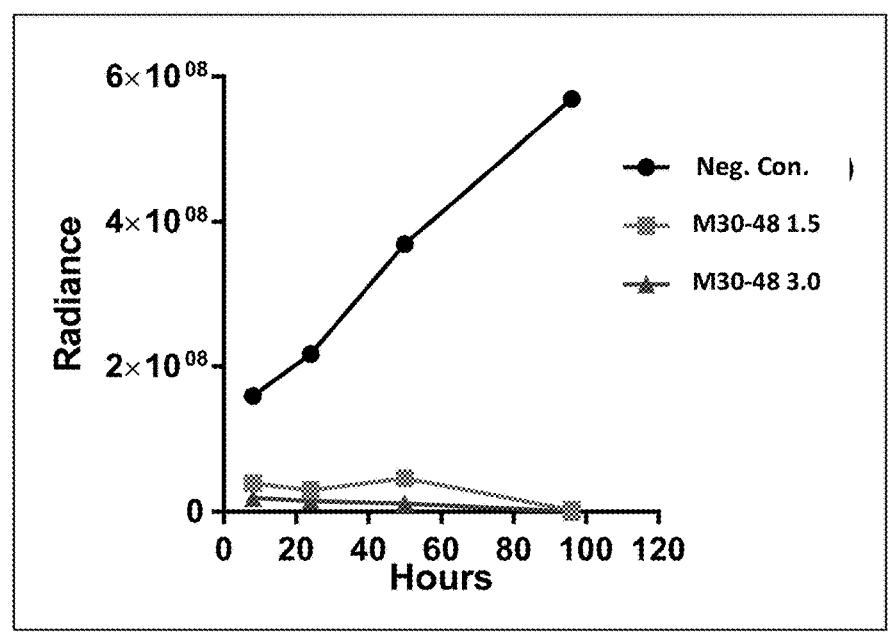
FIG. 14B shows quantification of luciferase activity in orthotopic HNSCC tumors by engineered miR-30 mimic M30-048 with local treatment.

Referring to FIG. 14A-B, this figure shows local tumor treatment with engineered mimic M30-048. FIG. 14A shows Female SCID mice were implanted with UM-SCC-$1^{Luc}$ subline in floor-of-mouth on the left side of their oral cavity. 14 days after tumor implantation, bioluminescence was monitored in live animals using In Vivo Imaging System (IVIS) by dosing with D-luciferin at 150 mg/kg via IP injection. Engineered mimic, M30-048, or a Negative control mimic (Neg. Con.) was formulated into an Atelocollagen gel using the AteloGene® local kit (koken). Animals were treated with a single treatment of 1.5 mg/kg or 3 mg/kg of M30-048 or 3 mg/kg of Neg. Con mimic and silencing of luciferase was monitored for 96 hrs. FIG. 14B displays quantitation of luciferase signal which is completely silenced by 96 hours at both doses.

Referring to FIG. 15, this figure shows natural miR-29 guide strand sequences and examples of engineered family members. Shown are the sequences of the natural miR-29 family members found in human (i.e. miR-29a-c-3p). Sequence variation between the different family members as compared to miR-29c-3p are highlighted in grey. Examples of non-natural sequences comprising subsets of engineered family members can include (i) combining the natural differences between miR-29a-3p and miR-29b-3p into hybrid sequences (Hybrid); (ii) A-to-G and/or U-to-G base mutations at positions 14 and/or 15, respectively (Mutation); (iii) guanidine base insertion at position 15 (Insert.); and (iv) sequences combining mutation with the base insertion into miR-29b-3p (Mut.+Insert.) or hybrid sequence (Hybrid+Mut.+Insert.). Non-natural sequence changes are highlighted in light grey. Trimming the 3' end by 1-2 nt is also indicated to comprise additional variants.

Figure 16:
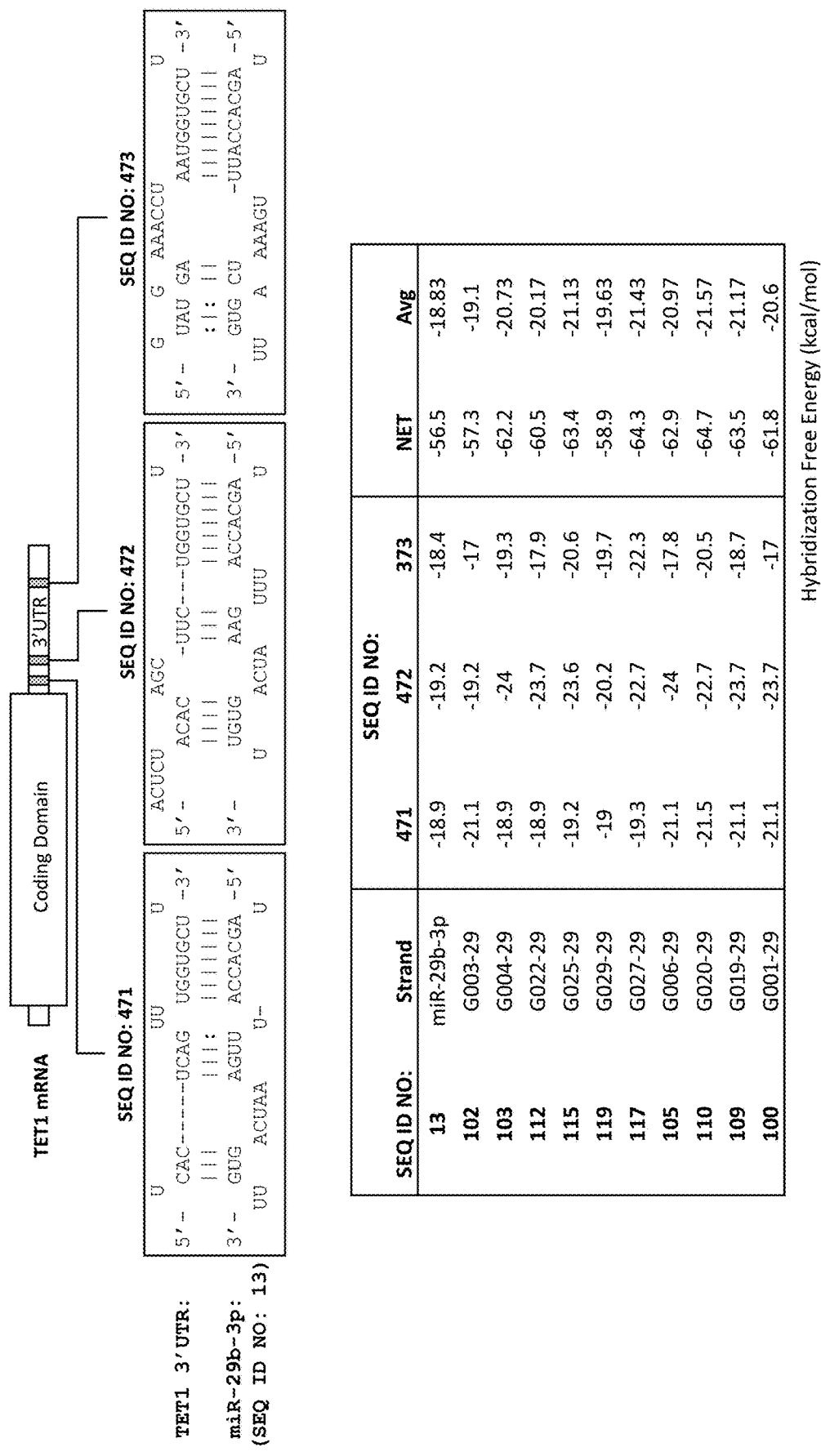
FIG. 16 shows a schematic visualization of a human host cell gene TET-1 and improved predicted binding by engineered miR-29 mimics.

Referring to FIG. 16, this figure shows a schematic visualization of a human host cell gene that is an epigenetic modifier and is involved cancer and reactivation of latent HIV virus. Shown is an illustration of the TET1 mRNA including its coding domain and three experimentally-validated miR-29 target sites (indicated in grey) within its 3'UTR. Hybridization between natural miR-29b-3p and the TET1 target sites, as well as calculated free energy (ΔG) for miR-29-3p and the indicated artificial guide strands were calculated using the software RNAhybrid 2.2 (https://bibiserv.cebitec.uni-bielefeld.de/rnahybrid). Net sum of free energy across all three target sites (NET) and their averaged ΔG (Avg.) is also indicated. Note all artificial guide strands can have lower calculated net and averaged free energy for hybridization than natural miR-29b-3p inferring improved target recognition. As with the NEF example depicted in FIG. 22, the engineered miR-29 guide strands depicted in FIG. 16 can be used to bind and inhibit an mRNA expressing a TET1 host protein with a lower predicted free energy (ΔG), a greater specificity, and greater complementarity, than corresponding natural miRNA sequences lacking the modifications described herein. Since TET1 is important in many disorders included Cancer and viral infections, this demonstrates that the engineered miR-29 guide strands may have improved properties as therapeutic agents by improving targeting of TET1.

Figure 17:
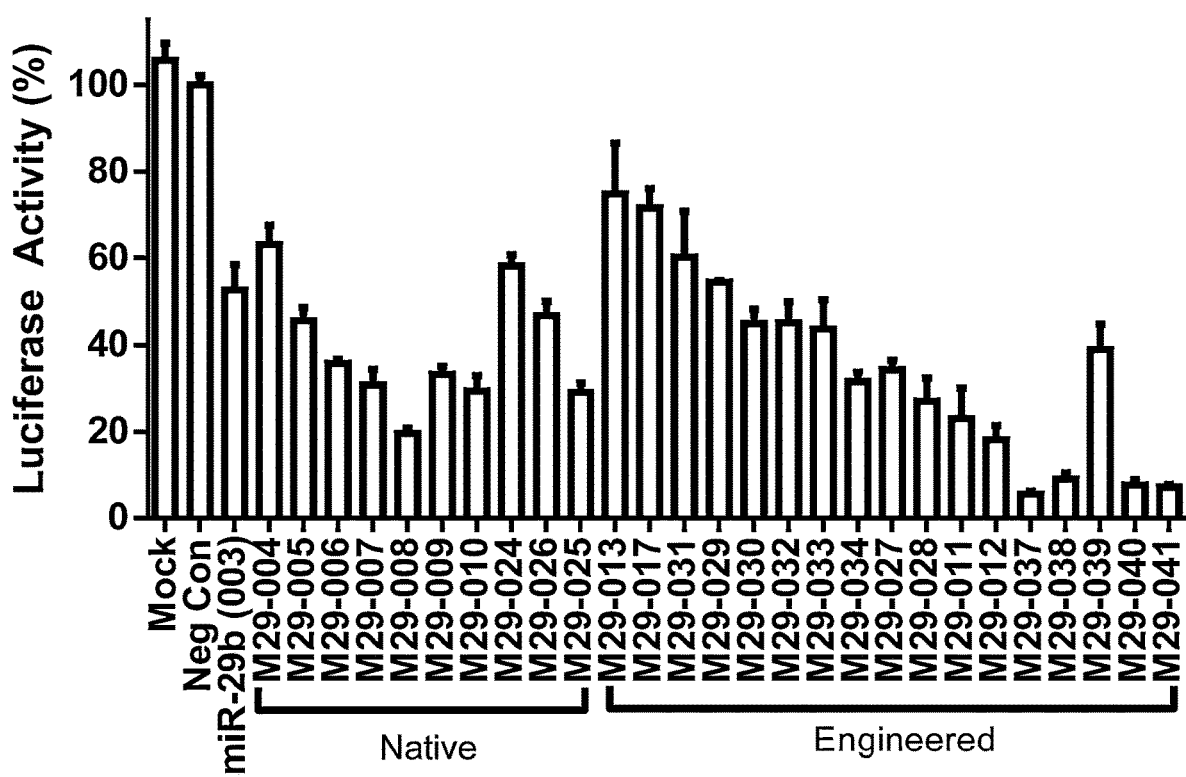
FIG. 17 figure shows that engineered miR-29 mimics can have equivalent or greater knockdown activity compared to native miR-29b in a luciferase cell line.

Referring to FIG. 17 this figure shows miR-29 mimics can have equivalent or greater knockdown activity compared to native miR-29b-1. Luciferase activity of a stable subline of HEK cells ( ) genetically engineered to overexpress a luciferase reporter containing a miR-29 target site within its 3'UTR. HEK$^{luc}$ cells were plated in 96-well plates and transfected with 15 nM mimics using RNAimax agent 6 hrs after plating for 3 days before cell lysis and luciferase assay. Mock treatments were transfected in the absence of mimic. All data represent mean±SEM from three independent experiments 72 hours after transfection.

Figures 18A, 18B:
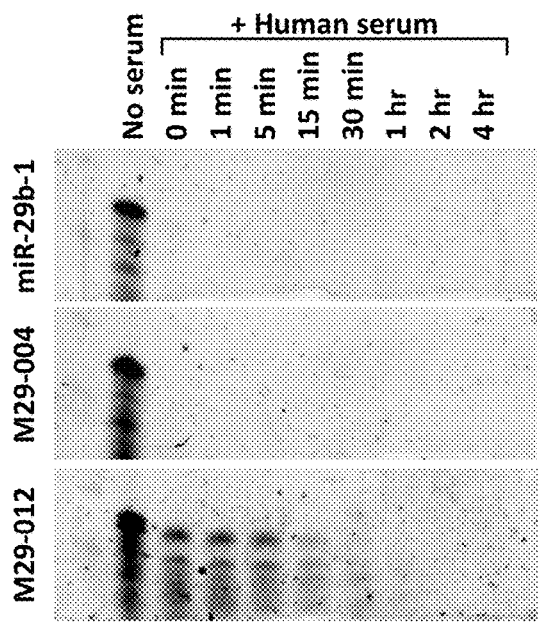
FIG. 18A shows sequence and structure of native miR-29b-1 duplex and engineered miR-29 mimics.
FIG. 18B shows duplex stability of native and engineered miR-29 miRNA mimics in human serum.

Referring to FIG. 18A-B, this figure shows passenger strand modification impacts mimic stability in absence of chemical modifications to the guide strand. FIG. 18A shows sequence comparison of native miR-29b-1 duplex to mimics M29-004 and M29-012 in which their passenger strands (top strand) contain three terminal 2'O-methyl nucleotides (bold) on both ends with an amino-carbon 6 chain (Amino C6) 5'-cap. Duplex complementarity was enhanced via sequence alterations in M29-012. In some cases, chemical modifications can be performed to any of the guide strands. FIG. 18B shows that reduction in duplex bulges in combination with the chemical modification pattern of the passenger strand contributes to improving duplex stability in absence of additional chemical modification of the guide strand. 5 μM of miR-29b-1 and the miR-29 mimics were incubated in 10% human sera at 37° C. for the indicated lengths of time. Duplex stability was visualized at the indicated time points by denaturing Urea-PAGE.

Figures 19A, 19B:
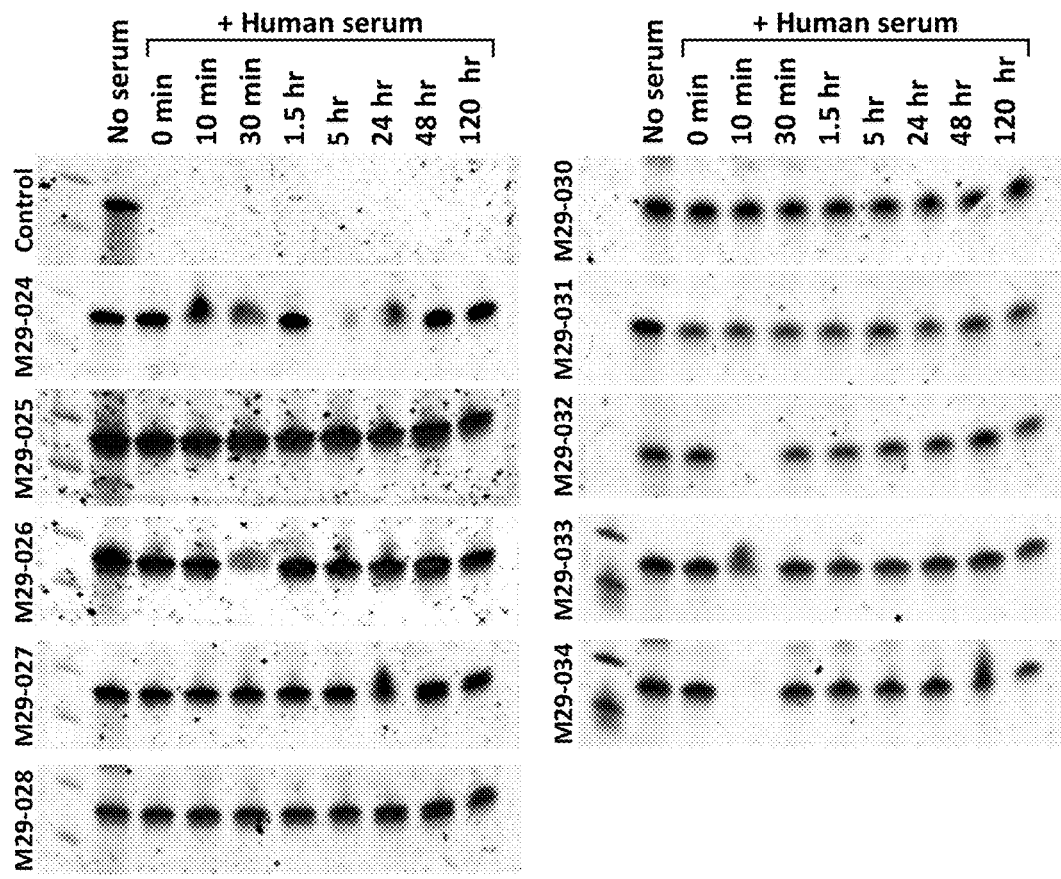
FIG. 19A shows sequence and structure of exemplar engineered miR-29 mimics.
FIG. 19B shows duplex stability of exemplar engineered miR-29 miRNA mimics in human serum.

Referring to FIG. 19A-B, this figure shows chemical modifications can improve miR-29 mimic stability. FIG. 19A shows sequence and structure of exemplar engineered miR-29 mimics with chemical modifications to stabilize them to human nucleases. FIG. 19B shows miR-29 mimics were incubated in 10% human sera at 37° C. for the indicated lengths of time. Duplex stability at each time point was visualized by denaturing Urea-PAGE. Time points without bands or with prominent smearing are either missing samples time points or user loading error, respectively.

Figure 20C:
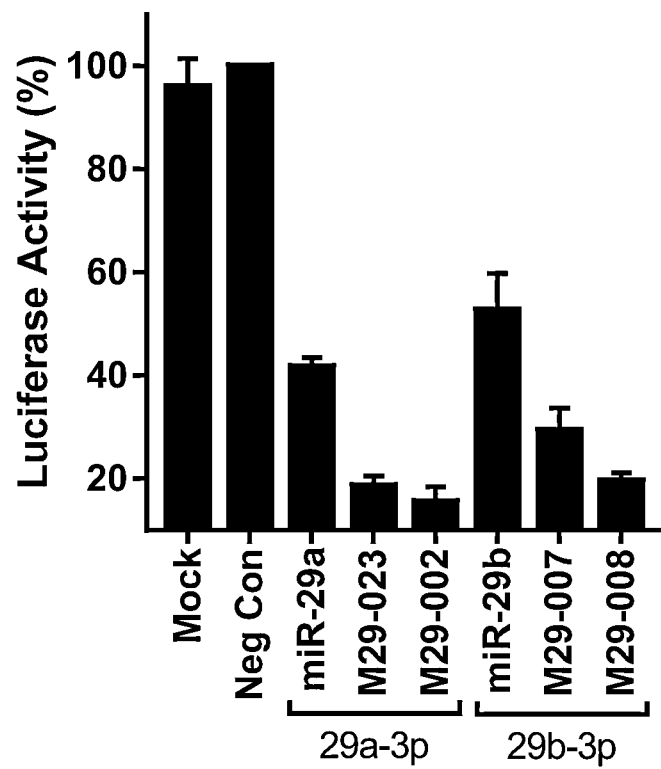
FIG. 20C shows improvement of luciferase knockdown activity by exemplar engineered mimics of miR-29a and miR-29b.

Referring to FIG. 20A-C, this figure shows passenger strand modification that can improve native miR-29a-3p and miR-29b-3p knockdown activity. FIG. 20A shows sequence comparison of native miR-29a duplex with mimics M29-023 and M29-002, which differ by passenger strand composition. All three duplexes contain unmodified, natural miR-29a-3p guide strand sequence. Bases in bold contain 2'-O-methyl. Amino-carbon 6 chain (Amino C6) modification of the 5' terminus for the indicated passenger strands is also shown. FIG. 20B shows sequence comparison of native miR-29b duplex with mimics M29-007 and M29-008. All three duplexes contain the same unmodified, natural miR-29b-3p guide strand sequence. FIG. 20C shows luciferase activity following treatments of stable subline of HEK cells (HEK$^{luc}$) genetically engineered to overexpress a luciferase reporter containing a miR-29 target site within its 3'UTR with 15 nM native miR-29a, native miR-29b, and miR-29 mimics. All data represent the mean±SEM from three independent experiments where cells were assayed 72 hours post-transfection. The knockdown activity of mimics containing either native miR-29a-3p (29a-3p) or miR-29b-3p (29b-3p) can be improved over natural miR-29a and miR-29b duplexes by hybridizing guide strands with modified passenger strands.

Referring to FIG. 21, this figure displays reductions in innate immunostimulation for engineered miR-29 mimics. Human Peripheral Blood Mononuclear Cells (PBMCs) (~2× $10^5$ cells) were plated in round bottom 96 well plates and transfected at 133 nM concentrations of the indicated mimics for 48 hours with RNAiMAX reagent. Levels of IFN-α and TNF-α in supernatant were quantified by ELISA. Poly (dA:dT) oligonucleotide and non-modified RNA duplex with known strong stimulatory effects (Pos Con) served as positive controls for immunostimulation. Transfection with non-chemically modified miR-29a and miR-29b duplexes (Non-mod) served as comparative controls for the indicated example mimics containing chemical modifications. Cells treated in in absence of mimic served to establish baseline.

Figure 22C:
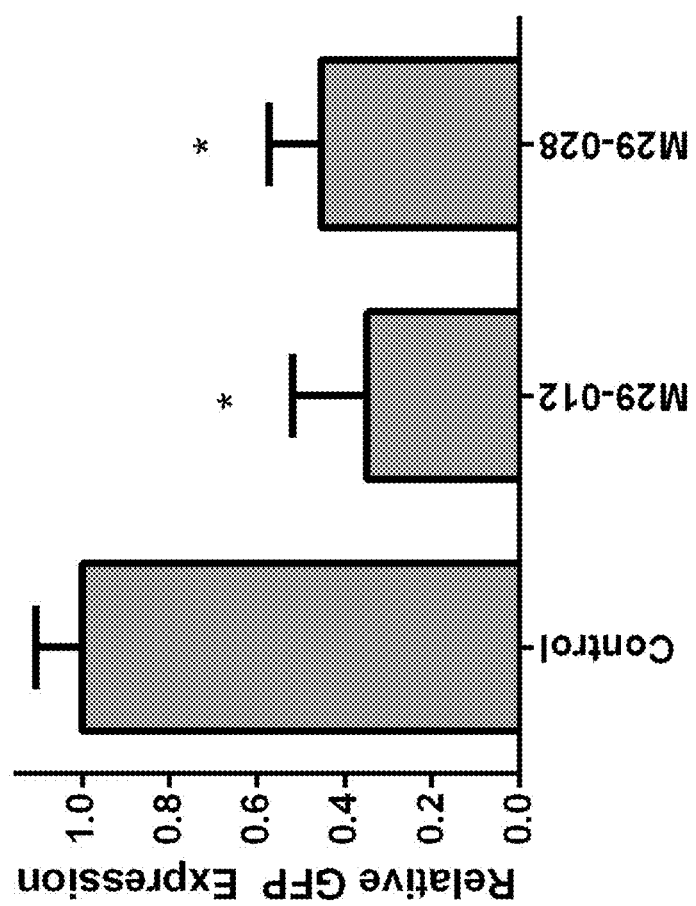
FIG. 22C shows decreased GFP reporter expression by M29-012 and M29-028 mimics.

Referring to FIG. 22A-B, this figure shows a schematic visualization of an HIV viral RNA transcript that codes for a viral protein (NEF) and can be an antiviral target for HIV. FIG. 22A shows free energy (ΔG) and hybridization between natural miR-29b-3p with its cognate target site in the viral transcript of NEF was calculated using the software RNAhybrid 2.2 (https://bibiserv.cebitec.uni-bielefeld.de/rnahybrid). For example, artificial miR-29 guide strands consisting of hybrid sequence (G003-29) and/or other non-natural changes (G004-29, G020-29, G027-29, and G031-29) can have lower predicted free energy (ΔG) and greater complementarity inferring improved target recognition. Improved target recognition, as demonstrated herein, can result in a decrease in a Gibbs Free Energy of binding of an engineered oligonucleotide for a target RNA, can result in an increase specificity of the engineered oligonucleotide for the target RNA, among a plurality of other RNA sequences, or a combination of these features. Accordingly, the engineered miR-29 guide strands depicted in FIG. 22A can be used to bind and inhibit an mRNA expressing a NEF viral protein with a lower predicted free energy (ΔG), a greater specificity, and greater complementarity, than corresponding natural miRNA sequences lacking the modifications described herein. Thus, the engineered miR-29 guide strands can display a potent anti-viral activity against HIV viruses or other virus displaying a NEF viral protein as demonstrated in FIG. 22B. FIG. 22C shows $3*10^4$ CD4+ human t-cells were transfected with 100 nM of either control, M29-012 or M29-028 mimic. 24 hours post-transfection cells were infected with pNL4-HIV, which contains a GFP reporter cloned nest to the NEF gene. Relative GFP expression, measured 36 hours post-infection by flow cytometry, was significantly reduced in cells pre-treated with M29-012 and M29-028.

Figure 23A:
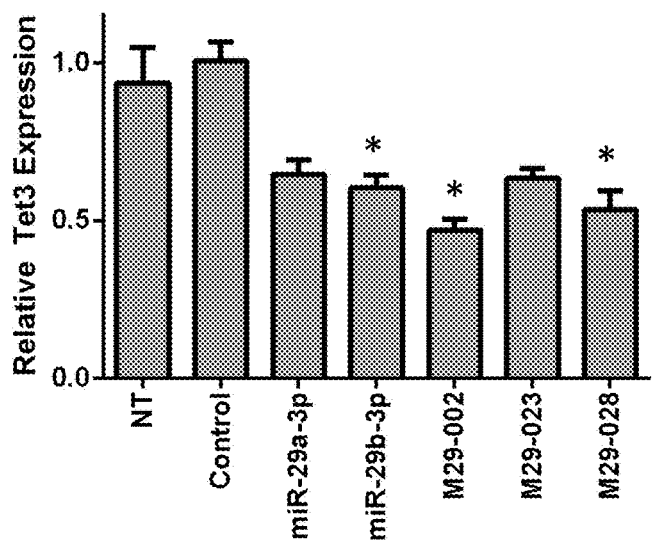
FIG. 23A, FIG. 23B and FIG. 23C shows improved knockdown of HIV-1 relevant host mRNAs by engineered mimics of miR-29.
Figure 23B:
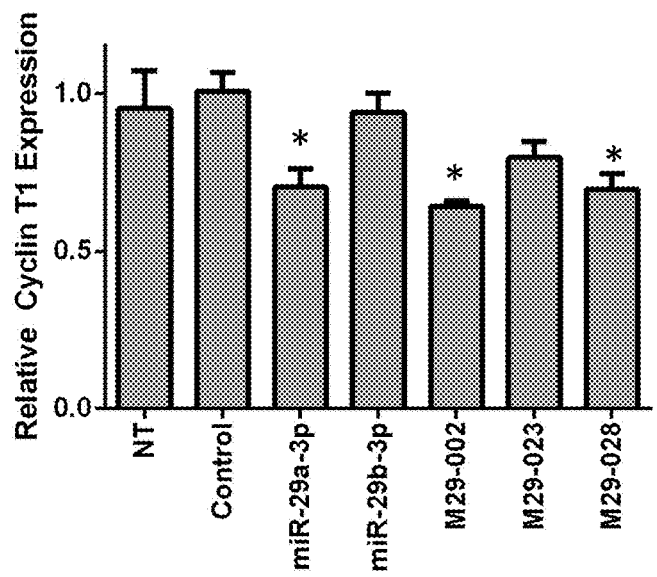
Figure 23C:
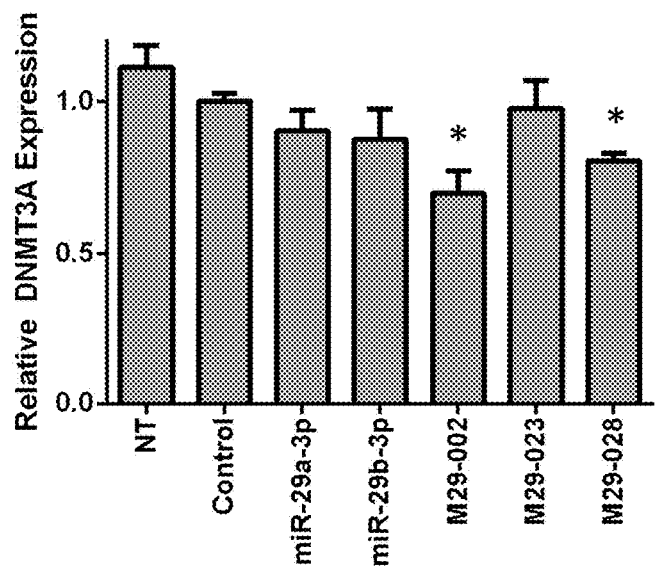
Figure 25C:
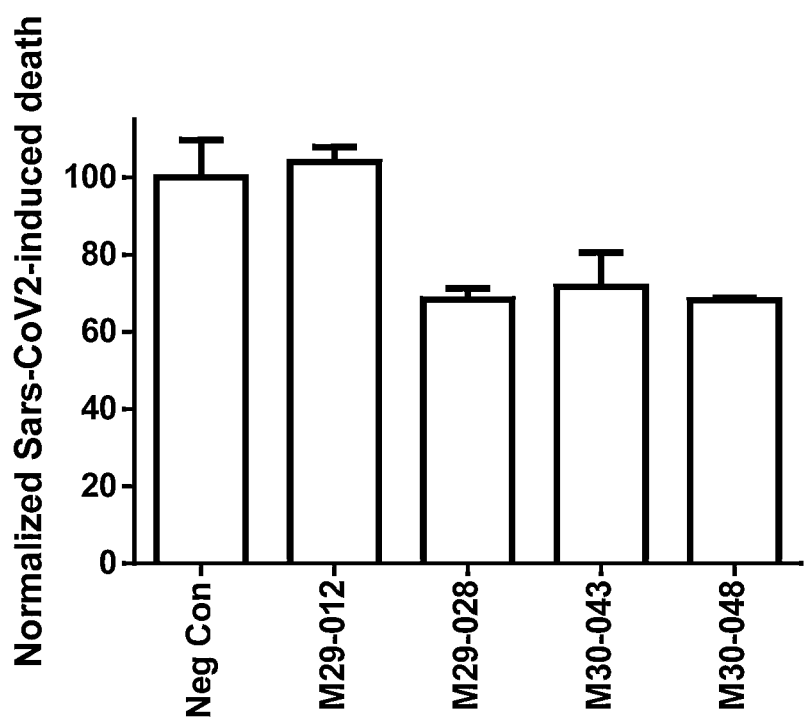
FIG. 25C shows inhibition of SARS-CoV-2 viral replication by exemplar engineered miR-29 and miR-30 mimics.
Figure 27:
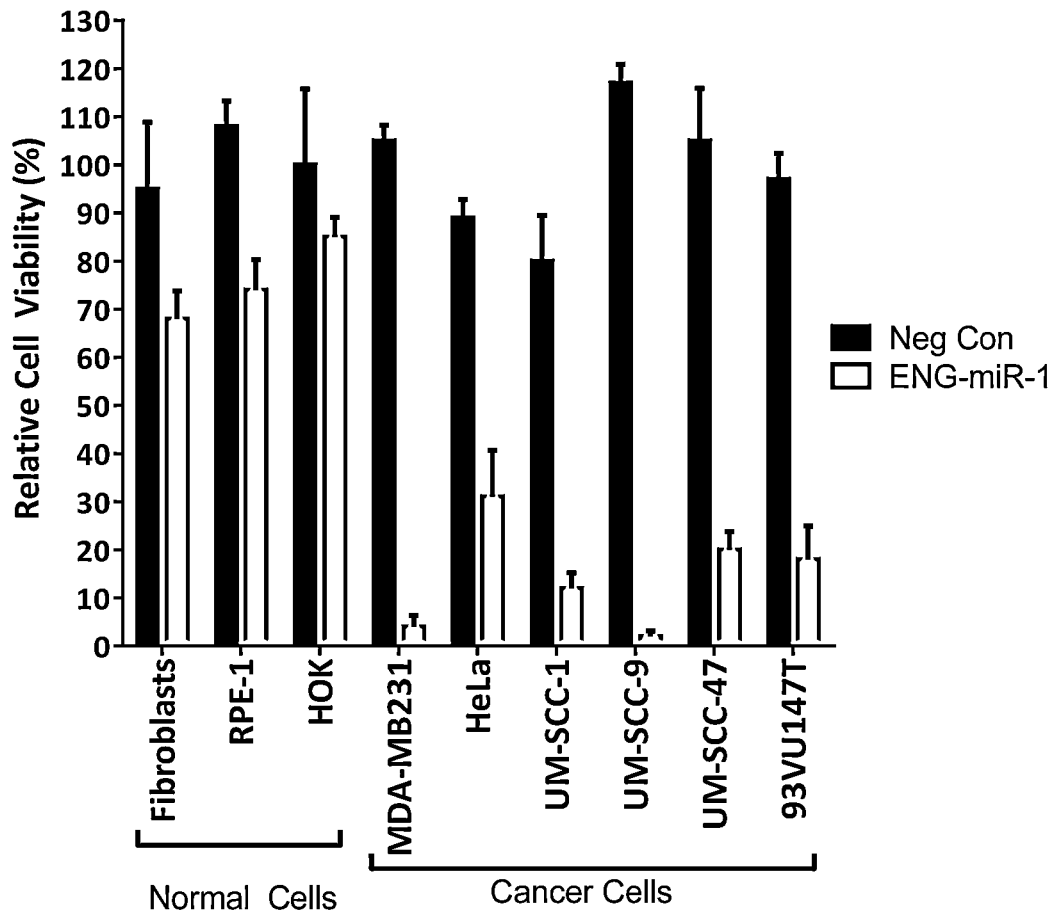
FIG. 27 shows cell killing activity of anti-cancer engineered artificial miRNA mimic ENG-miR-1 in normal and cancer cell lines.

Referring to FIG. 23A-C, this figure shows knockdown of mRNAs related to HIV replication and latency by miR-29a-3p, miR-29b-3p, M29-002, M29-023, and M29-028. $1\times10^5$ Jurkat t-cells were plated in 1 mL of media in 6 well plates and immediately treated with 100 nM control, natural miR-29a, natural miR-29b, or miR-29 mimics for 72 hours formulated into transfection agent. Cells were collected and total RNA was purified by directzol kits. Following reverse transcription relative expression of miR-29 target genes Tet3 (FIG. 23A), Cyclin T1 (FIG. 23B), and DNMT3A (FIG. 23C) was assessed by quantitative RT-PCR. Values represent the mean of three biological replicates and error bars represent SEM. * denotes p-value <0.05 by 2 tailed student's T-test. In all cases the engineered mimics of miR-29 have improved knockdown of targeted mRNA than the natural miRNAs.

Referring to FIG. 24A-B, this figure shows calculated free energy requirements for target recognition of mimic miR-29 (FIG. 24A) and miR-30 (FIG. 24B) family guide strands to SARS viral transcript. miR-29 mimic exemplary guide strand constructs are indicated. miR-29 guide sequences, for example SEQ. ID. NO. 12 or SEQ. ID. NO. 103, and miR-30 guide sequences, for example SEQ. ID. NO. 86 or SEQ. ID. NO. 88, can have antiviral activity against the SARS virus.

Referring to FIG. 25A-C, this figure shows calculated free energy requirements for target recognition of mimic miR-29 (FIG. 25A) and miR-30 (FIG. 25B) family guide strands to SARS-CoV-2 viral transcript. Hybridization and binding free energy (ΔG) between select guide strands and three predicted targets were calculated using the software RNAhybrid 2.2 (https://bibiserv.cebitec.uni-bielefeld.de/rnahybrid). Net sum of free energy across all three target sites (NET) and their averaged ΔG (Avg.) is also indicated. FIG. 25C demonstrates the protective effects of exemplar engineered miR-29 (M29-028) and miR-30 mimics against (M30-043 and M30-48) SARS-CoV-2- induced cell death. $5\times10^3$ Vero cells were plated in 29 well plates and 6 hrs after plating transfected with 25 nM control, M29-028, M30-043 or M30-048 mimics and then infected with SARS-CoV-2 (MOI 0.03) 24 hours later. After another 72 hours, cells were assayed for viral-induced cytopathic effect using viral toxglo assay (Promega). Pre-treatment with either M29-028, M30-43 or M30-048 resulted in ~30-40% less viral-induced cell death. miR-29 guide sequences, for example SEQ. ID. NO. 102 or SEQ. ID. NO. 109, and miR-30 guide sequences, for example SEQ. ID. NO. 86 or SEQ. ID. NO. 88, can have antiviral activity against the SARS-CoV-2 virus.

Referring to FIG. 26, this figure shows calculated free energy requirements for target recognition of mimic miR-29 family guide strands to HCV Genotype 1 transcript. miR-29 mimic exemplary guide strand constructs are indicated. miR-29 guide sequences, for example SEQ. ID. NOs. 12, 13, 102, 103, 112, 115, 119, 117, 105, 110, 109, 100, can have antiviral activity against the HCV Genotype 1.

The antiviral properties of the miR-29, miR-30, or miR-26 families can also be conserved amongst other RNA-based viruses that contain target sites within their genome or depend on similar host gene transcripts (e.g. TET1, TET2, TET3, etc.). Based on seed sequence complementarity, 26 and 32 candidate target sites in the genomic transcripts of SARS and SARS-CoV-2 coronavirus, respectively. Calculated free energy (ΔG) for three example targeted sites indicate that many of the artificial family member can have improved binding potential over native miR-29a-3p, miR-29b-3p, or miR-30a-5p in both SARS (FIG. 24) and SARS-CoV-2 (FIG. 25) genomic transcript. Similarly, artificial family members also demonstrated improved calculated binding across three candidate target sites in Hepatitis C virus (HCV) genome (FIG. 26). The mimics, including artificial family members, may have broad acting antiviral properties at treating or preventing infection of RNA-based viruses.

SEQ ID NOS: 500-531, 829-831 (Table 6) shows miR-29 target sequences in a COVID-19 Coronavirus (SARS-CoV-2) genomic RNA. For example, target sequences in the COVID-19 genome indicated by SEQ. ID. NO. 500 or SEQ. ID. NO. 502 can be targeted by one or more constructs as described herein, such as one or more miR-29 constructs.

SEQ ID NOS: 474-499, 826-828 (Table 6) shows miR-29 target sequences in a SARS Coronavirus (SARS-CoV) genomic RNA. For example, target sequences in the SARS genome indicated by SEQ. ID. NO. 474 or SEQ. ID. NO. 475 can be targeted by one or more constructs as described herein, such as one or more miR-29 constructs.

SEQ ID NOS: 532-554 (Table 6) shows miR-29 target sequences in a MERS Coronavirus (MERS-CoV) genomic RNA. For example, target sequences in the MERS genome indicated by SEQ. ID. NO. 535 or SEQ. ID. NO. 537 can be targeted by one or more constructs as described herein, such as one or more miR-29 constructs.

SEQ ID NOS: 555-586 (Table 6) shows miR-29 target sequences in a HKU1 Coronavirus (CoV-HKU1) genomic RNA. For example, target sequences in the HKU1 genome indicated by SEQ. ID. NO. 556 or SEQ. ID. NO. 566 can be targeted by one or more constructs as described herein, such as one or more miR-29 constructs.

Referring to Table 9 and FIG. 27, this figure shows engineered artificial anti-cancer miRNA mimic E1-001 which has no similar natural ncRNA. The Guide strand of E1-001, G001-E1, is engineered to target single and multiple sites in the 3' UTRs of several oncogenic mRNAs. Table 9 shows calculated free energy requirements for target recognition of G001-E1 guide strand to the targeted sites in the oncogenic mRNAs. Hybridization and binding free energy (ΔG) were calculated using the software RNAhybrid 2.2 (https://bibiserv.cebitec.uni-bielefeld.de/rnahybrid). FIG. 27 displays activity of engineered artificial miRNA E1-001 in normal non-cancerous cells including fibroblasts, retinal pigment epithelial cell line (RPE-1) or human oral keratinocytes (HOK) cells. Treatments were also performed on various cancer cell lines with different genetic backgrounds. Indicated cell lines were plated in 96-well plates and transfected with 7.5 nM E1-001 using RNAimax agent 6 hrs after plating for 5 days. Following treatment cell viability was assessed by XTT assay. Statistical significance (P<0.01) compared to Neg Con miRNA treatment is indicated. All Data represent the mean±SEM from a minimum three independent experiments. Cancer cell lines are significantly more sensitive than non-cancerous cells.

TABLE 9

Calculated binding free energy between ENG-miR-1 guide strand and various targets.

| SEQ ID NO: | Target | ΔG |
|---|---|---|
| 594 | CSNK1G1 site 1 | −17.4 |
| 595 | CSNK1G1 site 2 | −19.1 |
| 596 | CSNK1G1 site 3 | −20.5 |
| 597 | CSNK1G1 site 4 | −21.7 |
| 598 | CSNK1G1 site 5 | −21.3 |
| 599 | CSNK1G1 site 6 | −20.1 |
| 600 | ARHGAP26 site 1 | −20.3 |
| 601 | ARHGAP26 site 2 | −21.8 |
| 602 | ARHGAP26 site 3 | −17.6 |
| 603 | ARHGAP26 site 4 | −20.1 |
| 604 | ARHGAP26 site 5 | −18.1 |
| 605 | RAB11FIP1 site 1 | −27.3 |
| 606 | RAB11FIP1 site 2 | −17.2 |
| 607 | RAB11FIP1 site 3 | −17.2 |
| 608 | RAB11FIP1 site 4 | −18 |
| 608 | RBJ site 1 | −19.6 |
| 609 | RBJ site 2 | −18 |
| 610 | SERBP1 site 1 | −17.4 |
| 611 | SERBP1 site 2 | −18 |
| 612 | CTBP1 | −18.8 |
| 613 | CRKL | −24.7 |
| 614 | ITGA3 | −24.2 |
| 615 | ITGAV | −18.4 |
| 616 | LAMC1 | −17.1 |
| 617 | G6PC2 | −19.9 |
| 618 | PPP2R5E | −17.5 |
| 619 | KLF17 | −23.9 |

Referring to Table 10, this table shows engineered miR-205 guide strands and predicted free energy of binding for cancer-relevant RNAs in the 3' UTRs of ZEB1 (SEQ ID NO: 590), E2F1 (SEQ ID NO: 591), HER3 (SEQ ID NO: 592), and SHIP2 (SEQ ID NO: 593) gene transcripts. Lower predicted free energy (ΔG) infers improved target recognition. Target HER3 (PMID: 19276373) is an oncogene stimulating cancer grown while SHIP2 (PMID: 19033458) is a tumor suppressor inhibiting cancer growth. Exemplar Engineered guide strands G016-205 (SEQ ID NO: 260) and G011-205 (SEQ ID NO: 255) and predicted to have stronger targeting of HER3 and weaker targeting of SHIP2.

most members within the collagen superfamily. The miR-29 mimics may have further therapeutic potential in fibrotic/scarring pathologies.

TABLE 11 miR-29 Mimic Target Genes Linked to Tissue Scarring and Fibrosis

| Target Genes | Gene Ontology | Reference (PMID) |
|---|---|---|
| COL1A1, COL11A1, COL2A1, COL5A3, COL5A2, COL4A4, COL21A1, COL7A1, COL9A1, COL19A1, COL5A1, COL22A1, COL8A1, COL4A2, COL6A2, COL24A1, COL4A3, COL4A6, COL25A1, COL16A1, COL15A1 | Collagen Super Family; Extracellular Matrix Remodeling | 25785236; 31231509; 22772564 |
| PDGFB, PDGFC, PDGFRB | Platelet-Derived Growth Factors (PDGF) Signaling | 29155002; 28983598; 27816607; 25678385 |
| WISP1 | TGF-b/Wnt Signaling | 26867691 |
| LOXL2 | Collagen/Extracellular Matrix Remodeling | 30986934; 28073888; 23821193 |
| Elastin | Extracellular Matrix Remodeling | 10761639; 30944168 |
| TGFB2 | Transforming growth factor beta (TGF-b) Signaling | 26704519; 31992593; 31939600; 29615587 |
| HDGF | Hepatoma-derived growth factor (HDGF) Signaling | 19913322 |

TABLE 10

Calculated Free Energy Requirements for Target Recognition of Mimic Guide Strands to miR-205 Downstream Transcript

| | | Free energy ($\Delta G$)* [kcal/mol] | | | |
|---|---|---|---|---|---|
| SEQ ID NO: | Guide Strand | ZEB1 | E2F1 | HER3 | SHIP2 |
| 32 | miR-205-5p | −20.6 | −29.3 | −28 | −30.2 |
| 840 | G200-205 | −22 | −24.9 | −27.5 | −27.5 |
| 841 | G201-205 | −19.4 | −24.9 | −26.8 | −29.3 |
| 262 | G018-205 | −19.1 | −29.3 | −30.4 | −30.2 |
| 260 | G016-205 | −20.6 | −32.7 | −31.8 | −24.6 |
| 247 | G003-205 | −19.9 | −24.9 | −32.6 | −27.5 |
| 254 | G010-205 | −18.4 | −24.9 | −31.1 | −29.3 |
| 245 | G001-205 | −22 | −28.3 | −31.3 | −23.4 |
| 253 | G009-205 | 19.4 | −28.3 | −30.6 | −23.4 |
| 263 | G019-205 | −19.1 | −32.7 | −34.4 | −27.2 |
| 248 | G004-205 | −19.9 | −28.3 | −36.6 | −25.4 |
| 255 | G011-205 | −18.4 | −28.3 | −34.9 | −25.4 |
| 842 | G202-205 | −22.6 | −25.5 | −30.7 | −31.4 |
| 843 | G203-205 | −20.1 | −25.5 | −31.8 | −31.4 |
| 259 | G015-205 | −20.6 | −33.9 | −34.7 | −27 |
| 249 | G005-205 | −22.4 | −30.1 | −36.7 | −27.5 |
| 256 | G012-205 | −20.1 | −30.1 | −37.8 | −27.5 |
| 250 | G006-205 | −22.6 | −28.9 | −34.5 | −25.3 |
| 257 | G013-205 | −20.1 | −28.9 | −35.6 | −25.3 |
| 246 | G002-205 | −21.1 | −23.1 | −28 | −28.8 |
| 844 | G204-205 | −21.2 | −23 | −26.5 | −28.9 |
| 845 | G205-205 | −21.4 | −25.5 | −33.4 | −31.4 |
| 261 | G017-205 | −19.6 | −30.9 | −34.7 | −27.7 |
| 251 | G007-205 | −20.4 | −30.1 | −39.6 | −27.5 |
| 258 | G014-205 | −17.6 | −30.1 | −36.9 | −27.5 |
| 252 | G008-205 | −21.4 | −28.9 | −37.4 | −25.3 |

*Free energy ($\Delta G$) was calculated using RNAhybrid 2.2 between the indicated mimic guide strand sequences and target sites in the 3'UTRs of ZEB1 (SEQ ID NO: 590), E2F1 (SEQ ID NO: 591), HER3 (SEQ ID NO: 592), and SHIP2 (SEQ ID NO: 593) gene transcripts. Lower predicted free energy ($\Delta G$) infers improved target recognition.

Figure 28:
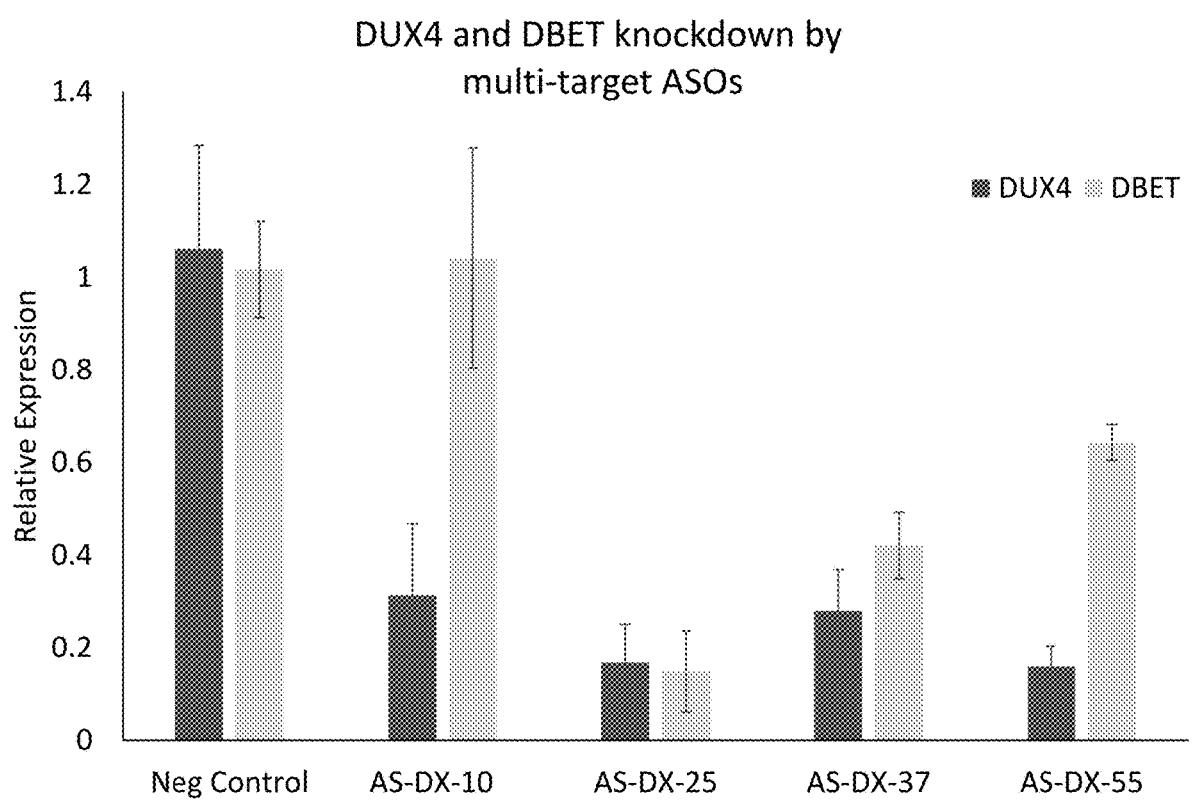
FIG. 28 shows simultaneous knockdown of DUX4 and DBET RNA transcripts in FSHD patient myoblasts by multi-targeted ASOs.

Referring to Table 11, this table shows miR-29 mimic target genes that may linked to tissue scarring and fibrosis. Analyses of candidate downstream target genes within the human genome identified enrichment for a number genes that can participate in tissue scarring and fibrosis including Referring to FIG. 28, this figure shows simultaneous knockdown of DUX4 and DBET RNA transcripts in FSHD patient myoblasts by multi-targeted antisense oligonucleotides (ASOs). AS-DX-10 only targets the DUX4 transcript, while AS-DX-25, -37, and -55 target both DUX4 and DBET transcripts. Immortalized 15Abic myoblast cells were plated in 12-well plates and the next day transfected with control or targeted ASOs at 50 nM using the transfection agent RNAiMAX. One day after plating differentiation media was added to induce myoblast formation and DUX4 expression. 72 hrs after transfection cells were lysed and total RNA was collected from the wells and RT-qPCR was performed to determine expression of DUX4 or DBET transcripts. ASOs AS-DX-25, -37, and -55 knockdown both DUX4 and DBET transcripts while AS-DX-10 only knocks down DUX4.

Figure 30:
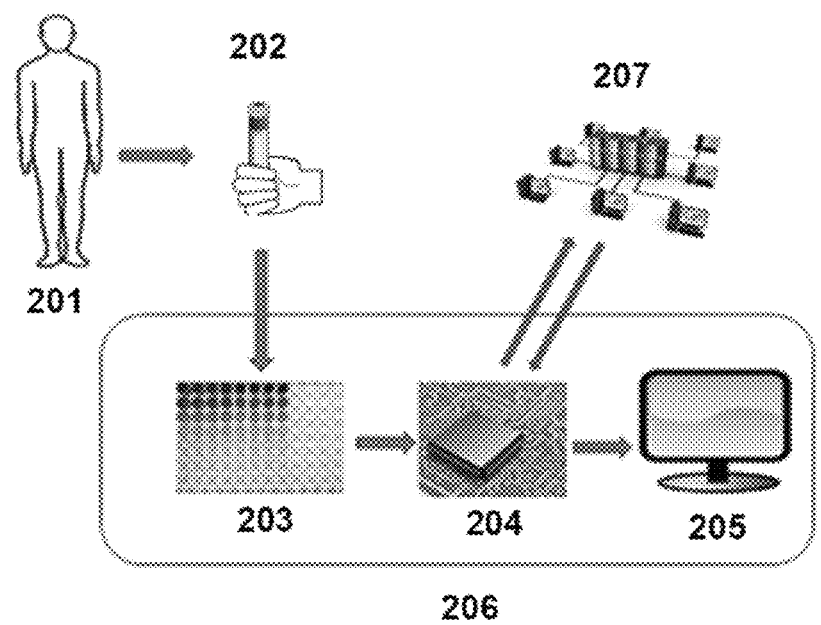
FIG. 30 shows a computer control system that is programmed or otherwise configured to implement methods provided herein.

In some cases, as shown in FIG. 30, a sample 202 containing a genetic material can be obtained from a subject 201, such as a human subject. A sample 202 can be subjected to one or more methods as described herein, such as performing an assay. In some cases, an assay can comprise sequencing (such as nanopore sequencing), genotyping, hybridization, amplification, labeling, or any combination thereof. One or more results from a method can be input into a processor 204. One or more input parameters such as a sample identification, subject identification, sample type, a reference, or other information can be input into a processor 204. One or more metrics from an assay can be input into a processor 204 such that the processor can produce a result, such as a diagnosis of degenerative disc disease or a recommendation for a treatment. A processor can send a result, an input parameter, a metric, a reference, or any combination thereof to a display 205, such as a visual display or graphical user interface. A processor 204 can (i) send a result, an input parameter, a metric, or any combination thereof to a server 207, (ii) receive a result, an input parameter, a metric, or any combination thereof from a server 207, (iii) or a combination thereof.

Computer Control Systems

Figure 29:
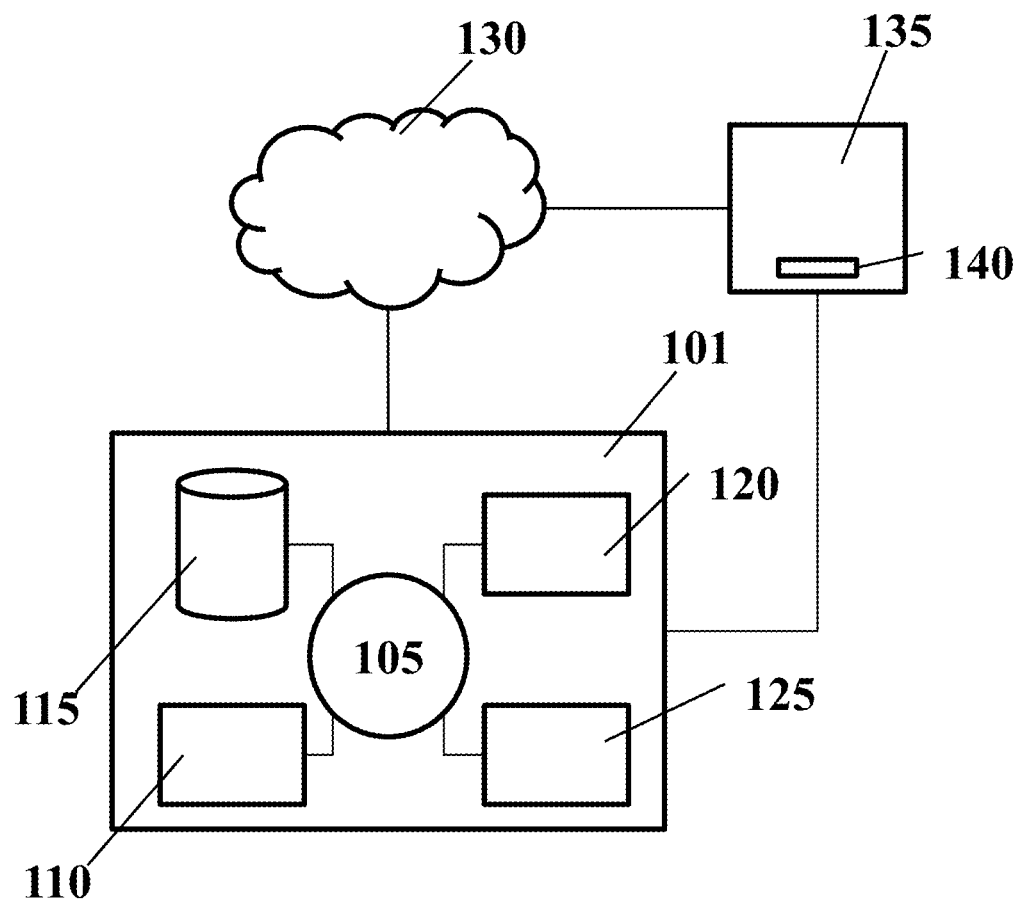
FIG. 29 is a diagram showing a method and system as disclosed herein.

The present disclosure provides computer control systems that are programmed to implement methods of the disclosure. FIG. 29 shows a computer system 101 that is programmed or otherwise configured to predict or confirm efficacy of various constructs for therapeutic effect, such as in cancer therapeutics or anti-viral therapeutics. The computer system 101 can regulate various aspects of the present disclosure, such as, for example, modeling or identifying constructs for various therapeutic targets, modeling efficacy or stability of constructs, or any combination thereof. The computer system 101 can be an electronic device of a user or a computer system that is remotely located with respect to the electronic device. The electronic device can be a mobile electronic device.

The computer system 101 includes a central processing unit (CPU, also "processor" and "computer processor" herein) 105, which can be a single core or multi core processor, or a plurality of processors for parallel processing. The computer system 101 also includes memory or memory location 110 (e.g., random-access memory, read-only memory, flash memory), electronic storage unit 115 (e.g., hard disk), communication interface 120 (e.g., network adapter) for communicating with one or more other systems, and peripheral devices 125, such as cache, other memory, data storage and/or electronic display adapters. The memory 110, storage unit 115, interface 120 and peripheral devices 125 are in communication with the CPU 105 through a communication bus (solid lines), such as a motherboard. The storage unit 115 can be a data storage unit (or data repository) for storing data. The computer system 101 can be operatively coupled to a computer network ("network") 130 with the aid of the communication interface 120. The network 130 can be the Internet, an internet and/or extranet, or an intranet and/or extranet that is in communication with the Internet. The network 130 in some cases is a telecommunication and/or data network. The network 130 can include one or more computer servers, which can enable distributed computing, such as cloud computing. The network 130, in some cases with the aid of the computer system 101, can implement a peer-to-peer network, which can enable devices coupled to the computer system 101 to behave as a client or a server.

The CPU 105 can execute a sequence of machine-readable instructions, which can be embodied in a program or software. The instructions can be stored in a memory location, such as the memory 110. The instructions can be directed to the CPU 105, which can subsequently program or otherwise configure the CPU 105 to implement methods of the present disclosure. Examples of operations performed by the CPU 105 can include fetch, decode, execute, and writeback.

The CPU 105 can be part of a circuit, such as an integrated circuit. One or more other components of the system 101 can be included in the circuit. In some cases, the circuit is an application specific integrated circuit (ASIC).

The storage unit 115 can store files, such as drivers, libraries and saved programs. The storage unit 115 can store user data, e.g., user preferences and user programs. The computer system 101 in some cases can include one or more additional data storage units that are external to the computer system 101, such as located on a remote server that is in communication with the computer system 101 through an intranet or the Internet.

The computer system 101 can communicate with one or more remote computer systems through the network 130. For instance, the computer system 101 can communicate with a remote computer system of a user. Examples of remote computer systems include personal computers (e.g., portable PC), slate or tablet PC's (e.g., Apple® iPad, Samsung® Galaxy Tab), telephones, Smart phones (e.g., Apple® iPhone, Android-enabled device, Blackberry®), or personal digital assistants. The user can access the computer system 101 via the network 130.

Methods as described herein can be implemented by way of machine (e.g., computer processor) executable code stored on an electronic storage location of the computer system 101, such as, for example, on the memory 110 or electronic storage unit 115. The machine executable or machine-readable code can be provided in the form of software. During use, the code can be executed by the processor 105. In some cases, the code can be retrieved from the storage unit 1115 and stored on the memory 110 for ready access by the processor 105. In some situations, the electronic storage unit 115 can be precluded, and machine-executable instructions are stored on memory 110.

The code can be pre-compiled and configured for use with a machine having a processor adapted to execute the code or can be compiled during runtime. The code can be supplied in a programming language that can be selected to enable the code to execute in a pre-compiled or as-compiled fashion.

Aspects of the systems and methods provided herein, such as the computer system 101, can be embodied in programming. Various aspects of the technology can be thought of as "products" or "articles of manufacture" typically in the form of machine (or processor) executable code and/or associated data that is carried on or embodied in a type of machine readable medium. Machine-executable code can be stored on an electronic storage unit, such as memory (e.g., read-only memory, random-access memory, flash memory) or a hard disk. "Storage" type media can include any or all of the tangible memory of the computers, processors or the like, or associated modules thereof, such as various semiconductor memories, tape drives, disk drives and the like, which can provide non-transitory storage at any time for the software programming. All or portions of the software can at times be communicated through the Internet or various other telecommunication networks. Such communications, for example, can enable loading of the software from one computer or processor into another, for example, from a management server or host computer into the computer platform of an application server. Thus, another type of media that can bear the software elements includes optical, electrical and electromagnetic waves, such as used across physical interfaces between local devices, through wired and optical landline networks and over various air-links. The physical elements that carry such waves, such as wired or wireless links, optical links or the like, also can be considered as media bearing the software. As used herein, unless restricted to non-transitory, tangible "storage" media, terms such as computer or machine "readable medium" refer to any medium that participates in providing instructions to a processor for execution.

Hence, a machine readable medium, such as computer-executable code, can take many forms, including but not limited to, a tangible storage medium, a carrier wave medium or physical transmission medium. Non-volatile storage media include, for example, optical or magnetic disks, such as any of the storage devices in any computer(s) or the like, such as can be used to implement the databases, etc. shown in the drawings. Volatile storage media include dynamic memory, such as main memory of such a computer platform. Tangible transmission media include coaxial cables; copper wire and fiber optics, including the wires that comprise a bus within a computer system. Carrier-wave transmission media can take the form of electric or electromagnetic signals, or acoustic or light waves such as those generated during radio frequency (RF) and infrared (IR) data communications. Common forms of computer-readable media therefore include for example: a floppy disk, a flexible disk, hard disk, magnetic tape, any other magnetic medium, a CD-ROM, DVD or DVD-ROM, any other optical medium, punch cards paper tape, any other physical storage medium with patterns of holes, a RAM, a ROM, a PROM and EPROM, a FLASH-EPROM, any other memory chip or cartridge, a carrier wave transporting data or instructions, cables or links transporting such a carrier wave, or any other medium from which a computer can read programming code and/or data. Many of these forms of computer readable media can be involved in carrying one or more sequences of one or more instructions to a processor for execution.

The computer system 101 can include or be in communication with an electronic display 135 that comprises a user interface (UI) 140 for providing, for example, one or more results (immediate results or archived results from a previous method), one or more user inputs, a reference value or derivative thereof from a library or database, or any combination thereof. Examples of UI's include, without limitation, a graphical user interface (GUI) and web-based user interface.

Methods and systems of the present disclosure can be implemented by way of one or more algorithms. An algorithm can be implemented by way of software upon execution by the central processing unit 105. The algorithm can, for example, determine optimized constructs via supervised learning to optimize therapeutic efficacy, stability, or other attribute of one or more constructs.

While exemplary embodiments have been shown and described herein, such embodiments are by way of example only. Numerous variations, changes, and substitutions can be performed on the exemplary embodiments. It should be understood that various alternatives to the embodiments described herein may be employed.

SEQUENCE LISTING (1120 sequences)

SEQ ID NO: 1 - RNA, 22 nt, Homo sapiens
uguaaacauccucgacuggaag

SEQ ID NO: 2 - RNA, 22 nt, Homo sapiens
uguaaacauccuacacucagcu

SEQ ID NO: 3 - RNA, 23 nt, Homo sapiens
uguaaacauccuacacucucagc

SEQ ID NO: 4 - RNA, 22 nt, Homo sapiens
uguaaacauccccgacuggaag

SEQ ID NO: 5 - RNA, 22 nt, Homo sapiens
uguaaacauccuugacuggaag

SEQ ID NO: 6 - RNA, 22 nt, Homo sapiens
cuuucagucggauguuugcagc

SEQ ID NO: 7 - RNA, 22 nt, Homo sapiens
cugggagguggauguuuacuuc

SEQ ID NO: 8 - RNA, 22 nt, Homo sapiens
cugggagaggguuguuuacucc

SEQ ID NO: 9 - RNA, 22 nt, Homo sapiens
cugggagaaggcuguuuacucu

SEQ ID NO: 10 - RNA, 22 nt, Homo sapiens
cuuucagucagauguuugcugc

SEQ ID NO: 11 - RNA, 22 nt, Homo sapiens
cuuucagucggauguuuacagc

SEQ ID NO: 12 - RNA, 22 nt, Homo sapiens
uagcaccaucugaaaucgguua

SEQ ID NO: 13 - RNA, 23 nt, Homo sapiens
uagcaccauuugaaaucaguguu

SEQ ID NO: 14 - RNA, 22 nt, Homo sapiens
uagcaccauuugaaaucgguua

SEQ ID NO: 15 - RNA, 22 nt, Homo sapiens
acugauuucuuuugguguucag

SEQ ID NO: 16 - RNA, 24 nt, Homo sapiens
gcugguuucauauggugguuuaga

SEQ ID NO: 17 - RNA, 22 nt, Homo sapiens
cugguuucacaugguggcuuag

SEQ ID NO: 18 - RNA, 22 nt, Homo sapiens
ugaccgauuucuccugguguuc

SEQ ID NO: 19 - RNA, 22 nt, Homo sapiens
uucaaguaauccaggauaggcu

SEQ ID NO: 20 - RNA, 21 nt, Homo sapiens
uucaaguaauucaggauaggu

SEQ ID NO: 21 - RNA, 22 nt, Homo sapiens
ccuauucuugguuacuugcacg

SEQ ID NO: 22 - RNA, 22 nt, Homo sapiens
ccuauucuugauuacuuguuuc

SEQ ID NO: 23 - RNA, 22 nt, Homo sapiens
ccuguucuccauuacuuggcuc

SEQ ID NO: 24 - RNA, 22 nt, Homo sapiens
agggcuuagcugcuugugagca

SEQ ID NO: 25 - RNA, 22 nt, Homo sapiens
agagcuuagcugauuggugaac

SEQ ID NO: 26 - RNA, 21 nt, Homo sapiens
uucacaguggcuaaguuccgc

SEQ ID NO: 27 - RNA, 21 nt, Homo sapiens
uucacaguggcuaaguucugc

SEQ ID NO: 28 - RNA, 21 nt, Homo sapiens
uacaguacugugauaacugaa

SEQ ID NO: 29 - RNA, 22 nt, Homo sapiens
caguuaucacagugcugaugcu

SEQ ID NO: 30 - RNA, 23 nt, Homo sapiens
guccaguuuucccaggaaucccu

SEQ ID NO: 31 - RNA, 22 nt, Homo sapiens
ggauuccuggaaauacuguucu

SEQ ID NO: 32 - RNA, 22 nt, Homo sapiens
uccuucauuccaccggagucug

SEQ ID NO: 33 - RNA, 21 nt, Homo sapiens
gauuucaguggagugaaguuc

SEQ ID NO: 34 - RNA, 22 nt, Homo sapiens
uccagcaucagugauuuuguug

SEQ ID NO: 35 - RNA, 22 nt, Homo sapiens
aacaauauccuggugcugagug

SEQ ID NO: 36 - RNA, 22 nt, Homo sapiens
uuuguucguucggcucgcguga

SEQ ID NO: 37 - RNA, 23 nt, Homo sapiens
gcgacgagccccucgcacaaacc

SEQ ID NO: 38 - RNA, 22 nt, Artificial Sequence
  Modified miR-30 guide strand
uguaaacauccugcgacuggaa

SEQ ID NO: 39 - RNA, 23 nt, Artificial Sequence
  Modified miR-30 guide strand
uguaaacauccugcgacuggaag

SEQ ID NO: 40 - RNA, 23 nt, Artificial Sequence
  Modified miR-30 guide strand
uguaaacaucccgcgacuggaag

SEQ ID NO: 41 - RNA, 23 nt, Artificial Sequence
  Modified miR-30 guide strand
uguaaacauccugugacuggaag

SEQ ID NO: 42 - RNA, 23 nt, Artificial Sequence
  Modified miR-30 guide strand
uguaaacaucccgugacuggaag

SEQ ID NO: 43 - RNA, 24 nt, Artificial Sequence
  Modified miR-30 guide strand
uguaaacauccugacacucucagc

SEQ ID NO: 44 - RNA, 23 nt, Artificial Sequence
  Modified miR-30 guide strand
uguaaacauccugacacucucag

SEQ ID NO: 45 - RNA, 22 nt, Artificial Sequence
  Modified miR-30 guide strand
uguaaacauccugacacucuca

SEQ ID NO: 46 - RNA, 19 nt, Artificial Sequence
  Modified miR-30 passenger strand
ccagucgaggauguuuaca

SEQ ID NO: 47 - RNA, 20 nt, Artificial Sequence
  Modified miR-30 passenger strand
ccagucgcaggauguuuaca

SEQ ID NO: 48 - RNA, 20 nt, Artificial Sequence
  Modified miR-30 passenger strand
uccagucgaggauguuuaca

SEQ ID NO: 49 - RNA, 21 nt, Artificial Sequence
  Modified miR-30 passenger strand
uccagucgcaggauguuuaca

SEQ ID NO: 50 - RNA, 18 nt, Artificial Sequence
  Modified miR-30 passenger strand
uccagucggauguuuaca

SEQ ID NO: 51 - RNA, 20 nt, Artificial Sequence
  Modified miR-30 passenger strand
uucagucggauguuugcagc

SEQ ID NO: 52 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): gm
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  modified_base (22)..(22): 2'-deoxyadenosine
  misc_feature (22)..(23): methylphosphonate linkage
  modified_base (23)..(23): gm
uguaaacauccugcgacuggaag

SEQ ID NO: 53 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): gm
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  modified_base (22)..(22): 2'-fluoroadenosine
  misc_feature (22)..(23): methylphosphonate linkage
  modified_base (23)..(23): gm
uguaaacauccugcgacuggaag

SEQ ID NO: 54 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): gm
  misc_feature (13)..(14): phosphorothioate linkage
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 55 - RNA, 22 nt, Artificial Sequence
  Modified miR-30 guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): gm
uguaaacauccucgacuggaag

SEQ ID NO: 56 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): gm
  misc_feature (13)..(14): methylphosphonate linkage
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 57 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  misc_feature (12)..(13): phosphorothioate linkage
  modified_base (13)..(13): gm
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 58 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  misc_feature (12)..(13): phosphorothioate linkage
  modified_base (13)..(13): gm
  misc_feature (13)..(14): phosphorothioate linkage
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 59 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  misc_feature (12)..(13): methylphosphonate linkage
  modified_base (13)..(13): gm
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 60 - RNA, 22 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (21)..(21): 2'-fluoroadenosine
  misc_feature (21)..(22): methylphosphonate linkage
  modified_base (22)..(22): 2'-O-methyladenosine
uguaaacauccugcgacuggaa

SEQ ID NO: 61 - RNA, 22 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 62 - RNA, 23 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  modified_base (22)..(22): 2'-fluoroadenosine
  misc_feature (22)..(23): methylphosphonate linkage
  modified_base (23)..(23): gm
uguaaacauccugcgacuggaag

SEQ ID NO: 63 - RNA, 22 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  modified_base (21)..(21): 2'-fluoroadenosine
  misc_feature (21)..(22): methylphosphonate linkage
  modified_base (22)..(22): 2'-O-methyladenosine
uguaaacauccugcgacuggaa

SEQ ID NO: 64 - RNA, 22 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 65 - RNA, 23 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): gm
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 66 - RNA, 23 nt, Artificial Sequence
  Modified miR-30 guide strand
  modified_base (11)..(11): cm
  modified_base (12)..(12): um
  modified_base (13)..(13): gm
  misc_feature (13)..(14): methylphosphonate linkage
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (21)..(22): phosphorothioate linkage
  modified_base (22)..(22): 2'-fluoroadenosine
  misc_feature (22)..(23): phosphorothioate linkage
  modified_base (23)..(23): 2'-O-methyladenosine
uguaaacauccugcgacuggaaa

SEQ ID NO: 67 - RNA, 23 nt, Artificial Sequence
  Modified miR-30 Guide strand
  modified_base (1)..(1): um
  misc_feature (1)..(2): phosphorothioate linkage
  modified_base (2)..(2): gm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 68 - RNA, 22 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): 2'-fluorocytidine
  modified_base (14)..(14): gm
  modified_base (15)..(15): 2'-fluoroadenosine
  modified_base (16)..(16): cm
  modified_base (17)..(17): 2'-fluorouridine
  modified_base (18)..(18): gm
  modified_base (19)..(19): 2'-fluoroguanosine
  modified_base (20)..(20): 2'-O-methyladenosine
  misc_feature (20)..(21): phosphorothioate linkage
  modified_base (21)..(21): 2'-fluoroadenosine
  misc_feature (21)..(22): phosphorothioate linkage
  modified_base (22)..(22): gm
uguaaacauccucgacuggaag

SEQ ID NO: 69 - RNA, 22 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): 2'-fluorocytidine
  modified_base (14)..(14): gm
  modified_base (15)..(15): 2'-fluoroadenosine
  modified_base (16)..(16): cm
  modified_base (17)..(17): 2'-fluorouridine
  modified_base (18)..(18): gm
  modified_base (19)..(19): 2'-fluoroguanosine
  modified_base (20)..(20): 2'-O-methyladenosine
  misc_feature (20)..(21): phosphorothioate linkage
  modified_base (21)..(21): 2'-fluoroadenosine
  misc_feature (21)..(22): phosphorothioate linkage
  modified_base (22)..(22): gm
uguaaacauccucgacuggaag

SEQ ID NO: 70 - RNA, 22 nt, Artificial Sequence
  Modified miR-30 guide strand
  modified_base (11)..(11): cm
  modified_base (12)..(12): um
  misc_feature (12)..(13): phosphorothioate linkage
  modified_base (13)..(13): gm
  misc_feature (13)..(14): phosphorothioate linkage
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 71 - RNA, 22 nt, Artificial Sequence
  Modified miR-30 guide strand
  modified_base (11)..(11): cm
  modified_base (12)..(12): um
  misc_feature (12)..(13): methylphosphonate linkage
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 72 - RNA, 22 nt, Artificial Sequence
  Modified miR-30 guide strand
  modified_base (10)..(10): 2'-fluorocytidine
  modified_base (11)..(11): cm
  modified_base (12)..(12): 2'-fluorouridine
  modified_base (13)..(13): gm
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 73 - RNA, 22 nt, Artificial Sequence
  Modified miR-30 guide strand
  modified_base (10)..(10): cm
  modified_base (11)..(11): 2'-fluorocytidine
  modified_base (12)..(12): um
  modified_base (13)..(13): 2'-fluoroguanosine
  modified_base (14)..(14): cm
  modified_base (15)..(15): 2'-fluoroguanosine
  modified_base (16)..(16): 2'-O-methyladenosine
  modified_base (17)..(17): 2'-fluorocytidine
  modified_base (18)..(18): um
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 74 - RNA, 22 nt, Artificial Sequence
  Modified miR-30 guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 75 - RNA, 22 nt, Artificial Sequence
  Modified miR-30 guide strand
  modified_base (11)..(11): cm
  modified_base (12)..(12): um
  misc_feature (13)..(14): phosphorothioate linkage
  modified_base (15)..(15): cm
  modified_base (16)..(16): gm
  modified_base (17)..(17): 2'-O-methyladenosine
  modified_base (18)..(18): cm
  modified_base (19)..(19): um
  modified_base (20)..(20): gm
  misc_feature (21)..(22): phosphorothioate linkage
  modified_base (22)..(22): 2'-fluoroadenosine
  misc_feature (22)..(23): phosphorothioate linkage
  modified_base (23)..(23): 2'-O-methyladenosine
uguaaacauccugcgacuggaa

SEQ ID NO: 76 - RNA, 23 nt, Artificial Sequence
  Modified miR-30 guide strand
  modified_base (11)..(11): cm
  modified_base (12)..(12): um
  modified_base (13)..(13): gm
  misc_feature (14)..(15): phosphorothioate linkage
  modified_base (16)..(16): gm
  modified_base (17)..(17): 2'-O-methyladenosine
  modified_base (18)..(18): cm
  modified_base (19)..(19): um
  modified_base (20)..(20): gm
  misc_feature (22)..(23): phosphorothioate linkage
  modified_base (23)..(23): 2'-fluoroadenosine
  misc_feature (23)..(24): phosphorothioate linkage
  modified_base (24)..(24): 2'-O-methyladenosine
uguaaacauccugcgacuggaaa

SEQ ID NO: 77 - RNA, 22 nt, Artificial Sequence
  Modified miR-30 guide strand
  modified_base (11)..(11): cm
  modified_base (12)..(12): um
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  misc_feature (20)..(21): phosphorothioate linkage
  modified_base (21)..(21): 2'-fluorocytidine
  misc_feature (21)..(22): phosphorothioate linkage
  modified_base (22)..(22): um
uguaaacauccuacacucagcu

SEQ ID NO: 78 - RNA, 22 nt, Artificial Sequence
  Modified miR-30 guide strand
  modified_base (11)..(11): cm
  modified_base (12)..(12): cm
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): gm
  misc_feature (20)..(21): phosphorothioate linkage
  modified_base (21)..(21): 2'-fluoroadenosine
  misc_feature (21)..(22): phosphorothioate linkage
  modified_base (22)..(22): gm
uguaaacauccccgacuggaag

SEQ ID NO: 79 - RNA, 23 nt, Artificial Sequence
  Modified miR-30 guide strand
  modified_base (11)..(11): cm
  modified_base (12)..(12): cm
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacaucccgcgacuggaag

SEQ ID NO: 80 - RNA, 23 nt, Artificial Sequence
  Modified miR-30 Guide strand
  modified_base (1)..(1): um
  misc_feature (1)..(2): phosphorothioate linkage
  modified_base (2)..(2): gm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 81 - RNA, 23 nt, Artificial Sequence
  Modified miR-30 Guide strand
  modified_base (1)..(1): um
  misc_feature (1)..(2): phosphorothioate linkage
  modified_base (2)..(2): gm
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 82 - RNA, 23 nt, Artificial Sequence
  Modified miR-30 Guide strand
  modified_base (1)..(1): um
  misc_feature (1)..(2): phosphorothioate linkage
  modified_base (2)..(2): gm
  misc_feature (2)..(3): phosphorothioate linkage
  modified_base (3)..(3): um
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 83 - RNA, 22 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): 2'-fluorocytidine
  modified_base (14)..(14): gm
  modified_base (15)..(15): 2'-fluoroadenosine
  modified_base (16)..(16): cm
  modified_base (17)..(17): 2'-fluorouridine
  modified_base (18)..(18): gm
  modified_base (19)..(19): 2'-fluoroguanosine
  modified_base (20)..(20): 2'-O-methyladenosine
  modified_base (21)..(21): 2'-deoxyadenosine
  misc_feature (21)..(22): methylphosphonate linkage
  modified_base (22)..(22): gm
uguaaacauccucgacuggaag

SEQ ID NO: 84 - RNA, 22 nt, Artificial Sequence
  Modified miR-30 guide strand
  modified_base (1)..(1): 2'-fluorouridine
  modified_base (2)..(2): gm
  modified_base (3)..(3): 2'-fluorouridine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): 2'-fluorocytidine
  modified_base (19)..(19): 2'-fluoroguanosine
  modified_base (20)..(20): 2'-O-methyladenosine
  misc_feature (20)..(21): phosphorothioate linkage
  modified_base (21)..(21): 2'-fluoroadenosine
  misc_feature (21)..(22): phosphorothioate linkage
  modified_base (22)..(22): gm
uguaaacauccucgacuggaag

SEQ ID NO: 85 - RNA, 23 nt, Artificial Sequence
  Modified miR-30 guide strand
  misc_feature (1)..(1): 5' O-methyl cap
  modified_base (1)..(1): 2 -deoxyuridine
  modified_base (2)..(2): gm
  modified_base (3)..(3): 2'-fluorouridine
  modified_base (4)..(4): 2'-O-methyladenosine
  modified_base (5)..(5): 2'-fluoroadenosine
  modified_base (6)..(6): 2'-O-methyladenosine
  modified_base (7)..(7): 2'-fluorocytidine
  modified_base (8)..(8): 2'-O-methyladenosine
  modified_base (9)..(9): 2'-fluorouridine
  modified_base (10)..(10): cm
  modified_base (11)..(11): 2'-fluorocytidine
  modified_base (12)..(12): um
  modified_base (13)..(13): gm
  modified_base (14)..(14): 2'-fluorocytidine
  modified_base (15)..(15): gm
  modified_base (16)..(16): 2'-fluoroadenosine
  modified_base (17)..(17): cm
  modified_base (18)..(18): 2'-fluorouridine
  modified_base (19)..(19): gm
  modified_base (20)..(20): 2'-fluoroguanosine
  modified_base (21)..(21): 2'-O-methyladenosine
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 86 - RNA, 22 nt, Artificial Sequence
  Modified miR-30 guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): gm
  misc_feature (20)..(21): phosphorothioate linkage
  modified_base (21)..(21): 2'-fluoroadenosine
  misc_feature (21)..(22): phosphorothioate linkage
  modified_base (22)..(22): gm
uguaaacauccucgacuggaag

SEQ ID NO: 87 - RNA, 23 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
uguaaacauccugcgacuggaag

SEQ ID NO: 88 - RNA, 23 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (21)..(22): phosphorothioate linkage
  modified_base (22)..(22): 2'-fluoroadenosine
  misc_feature (22)..(23): phosphorothioate linkage
  modified_base (23)..(23): gm
uguaaacauccugcgacuggaag

SEQ ID NO: 89 - RNA, 22 nt, Artificial Sequence
  Modified miR-30 guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
uguaaacauccugcgacuggaa

SEQ ID NO: 90 - RNA, 22 nt, Artificial Sequence
  Modified miR-30 passenger strand
  misc_feature (1)..(1): amino C6 linker
  modified_base (1)..(1): cm
  modified_base (2)..(2): um
  modified_base (3)..(3): gm
  modified_base (20)..(20): um
  modified_base (21)..(21): um
  modified_base (22)..(22): cm
cugggagguggauguuuacuuc

SEQ ID NO: 91 - RNA, 22 nt, Artificial Sequence
  Modified miR-30 passenger strand
  misc_feature (1)..(1): amino C6 linker
  modified_base (1)..(1): cm
  modified_base (2)..(2): um
  modified_base (3)..(3): um
  modified_base (20)..(20): um
  modified_base (21)..(21): gm
  modified_base (22)..(22): cm
cuuucagucagauguuugcugc

SEQ ID NO: 92 - RNA, 20 nt, Artificial Sequence
  Modified miR-30 Passenger strand
  misc_feature (1)..(1): amino C6 linker
  modified_base (1)..(1): um
  misc_feature (1)..(2): phosphorothioate linkage
  modified_base (2)..(2): cm
  misc_feature (2)..(3): phosphorothioate linkage
  modified_base (3)..(3): cm
  modified_base (8)..(8): gm
  modified_base (9)..(9): 2'-O-methyladenosine
  modified_base (18)..(18): 2'-O-methyladenosine
  misc_feature (18)..(19): phosphorothioate linkage
  modified_base (19)..(19): cm
  misc_feature (19)..(20): phosphorothioate linkage
  modified_base (20)..(20): 2'-O-methyladenosine
uccagucgaggauguuuaca

SEQ ID NO: 93 - RNA, 20 nt, Artificial Sequence
  Modified miR-30 Passenger strand
  misc_feature (1)..(1): amino C6 linker
  modified_base (1)..(1): um
  misc_feature (1)..(2): phosphorothioate linkage
  modified_base (2)..(2): cm
  misc_feature (2)..(3): phosphorothioate linkage
  modified_base (3)..(3): cm
  modified_base (7)..(7): cm
  modified_base (8)..(8): gm
  modified_base (9)..(9): 2'-O-methyladenosine
  modified_base (10)..(10): gm
  modified_base (18)..(18): 2'-O-methyladenosine
  misc_feature (18)..(19): phosphorothioate linkage
  modified_base (19)..(19): cm
  misc_feature (19)..(20): phosphorothioate linkage
  modified_base (20)..(20): 2'-O-methyladenosine
uccagucgaggauguuuaca

SEQ ID NO: 94 - RNA, 20 nt, Artificial Sequence
  Modified miR-30 Passenger strand
  misc_feature (1)..(1): amino C6 linker
  modified_base (1)..(1): um
  misc_feature (1)..(2): phosphorothioate linkage
  modified_base (2)..(2): cm
  misc_feature (2)..(3): phosphorothioate linkage
  modified_base (3)..(3): cm
  modified_base (7)..(7): cm
  modified_base (8)..(8): gm
  modified_base (9)..(9): 2'-O-methyladenosine
  modified_base (10)..(10): gm
  modified_base (11)..(11): gm
  modified_base (12)..(12): 2'-O-methyladenosine
  modified_base (13)..(13): um
  modified_base (14)..(14): gm
  modified_base (15)..(15): um
  modified_base (16)..(16): um
  modified_base (17)..(17): um
  modified_base (18)..(18): 2'-O-methyladenosine
  misc_feature (18)..(19): phosphorothioate linkage
  modified_base (19)..(19): cm
  misc_feature (19)..(20): phosphorothioate linkage
  modified_base (20)..(20): 2'-O-methyladenosine
uccagucgaggauguuuaca

SEQ ID NO: 95 - RNA, 18 nt, Artificial Sequence
  Modified miR-30 passenger strand
  misc_feature (1)..(1): amino C6 linker
  modified_base (1)..(1): um
  modified_base (2)..(2): cm
  modified_base (3)..(3): cm
  modified_base (16)..(16): 2'-O-methyladenosine
  modified_base (17)..(17): cm
  modified_base (18)..(18): 2'-O-methyladenosine
uccagucggauguuuaca

SEQ ID NO: 96 - RNA, 20 nt, Artificial Sequence
  Modified miR-30 passenger strand
  misc_feature (1)..(1): amino C6 linker
  modified_base (1)..(1): um
  modified_base (2)..(2): cm
  modified_base (3)..(3): cm
  modified_base (18)..(18): 2'-O-methyladenosine
  modified_base (19)..(19): cm
  modified_base (20)..(20): 2'-O-methyladenosine
uccagucgaggauguuuaca

SEQ ID NO: 97 - RNA, 21 nt, Artificial Sequence
  Modified miR-30 passenger strand
  misc_feature (1)..(1): amino C6 linker
  modified_base (1)..(1): um
  modified_base (2)..(2): cm
  modified_base (3)..(3): cm
  modified_base (19)..(19): 2'-O-methyladenosine
  modified_base (20)..(20): cm
  modified_base (21)..(21): 2'-O-methyladenosine
uccagucgcaggauguuuaca

SEQ ID NO: 98 - RNA, 19 nt, Artificial Sequence
  Modified miR-30 passenger strand
  misc_feature (1)..(1): amino C6 linker
  modified_base (1)..(1): cm
  modified_base (2)..(2): cm
  modified_base (3)..(3): 2'-O-methyladenosine
  modified_base (17)..(17): 2'-O-methyladenosine
  modified_base (18)..(18): cm
  modified_base (19)..(19): 2'-O-methyladenosine
ccagucgaggauguuuaca

SEQ ID NO: 99 - RNA, 20 nt, Artificial Sequence
  Modified miR-30 passenger strand
  misc_feature (1)..(1): amino C6 linker
  modified_base (1)..(1): cm
  modified_base (2)..(2): cm
  modified_base (3)..(3): 2'-O-methyladenosine
  modified_base (18)..(18): 2'-O-methyladenosine
  modified_base (19)..(19): cm
  modified_base (20)..(20): 2'-O-methyladenosine
ccagucgcaggauguuuaca

SEQ ID NO: 100 - RNA, 23 nt, Artificial Sequence
  Modified miR-29 guide strand
uagcaccaucugaaagcaguguu

SEQ ID NO: 101 - RNA, 22 nt, Artificial Sequence
  Modified miR-29 guide strand
uagcaccaucugaaaucagugu

SEQ ID NO: 102 - RNA, 23 nt, Artificial Sequence
  Modified miR-29 guide strand
uagcaccaucugaaaucaguguu

SEQ ID NO: 103 - RNA, 23 nt, Artificial Sequence
  Modified miR-29 guide strand
uagcaccauuugaagucaguguu

SEQ ID NO: 104 - RNA, 23 nt, Artificial Sequence
  Modified miR-29 guide strand
uagcaccauuugaaggucagugu

SEQ ID NO: 105 - RNA, 23 nt, Artificial Sequence
  Modified miR-29 guide strand
uagcaccaucugaagucaguguu

SEQ ID NO: 106 - RNA, 23 nt, Artificial Sequence
  Modified miR-29 guide strand
uagcaccaucugaaggucagugu

SEQ ID NO: 107 - RNA, 22 nt, Artificial Sequence
  Modified miR-29 guide strand
uagcaccaucugaaggcagugu

SEQ ID NO: 108 - RNA, 22 nt, Artificial Sequence
  Modified miR-29 guide strand
uagcaccauuugaaaucagugu

SEQ ID NO: 109 - RNA, 23 nt, Artificial Sequence
  Modified miR-29 guide strand
uagcaccaucugaaggcaguguu

SEQ ID NO: 110 - RNA, 24 nt, Artificial Sequence
  Modified miR-29 guide strand
uagcaccaucugaaggucaguguu

SEQ ID NO: 111 - RNA, 22 nt, Artificial Sequence
  Modified miR-29 guide strand
uagcaccauuugaaagcagugu

SEQ ID NO: 112 - RNA, 23 nt, Artificial Sequence
  Modified miR-29 guide strand
uagcaccauuugaaagcaguguu

SEQ ID NO: 113 - RNA, 21 nt, Artificial Sequence
  Modified miR-29 guide strand
uagcaccauuugaaagucagu

SEQ ID NO: 114 - RNA, 23 nt, Artificial Sequence
  Modified miR-29 guide strand
uagcaccauuugaaagucagugu

SEQ ID NO: 115 - RNA, 22 nt, Artificial Sequence
  Modified miR-29 guide strand
uagcaccauuugaaggcagugu

SEQ ID NO: 116 - RNA, 22 nt, Artificial Sequence
  Modified miR-29 guide strand
uagcaccauuugaaggucagug

SEQ ID NO: 117 - RNA, 24 nt, Artificial Sequence
  Modified miR-29 guide strand
uagcaccauuugaaggucaguguu

SEQ ID NO: 118 - RNA, 22 nt, Artificial Sequence
  Modified miR-29 guide strand
uagcaccauuugaagucagugu

SEQ ID NO: 119 - RNA, 24 nt, Artificial Sequence
  Modified miR-29 guide strand
uagcaccauuugaaagucaguguu

SEQ ID NO: 120 - RNA, 22 nt, Artificial Sequence
  Modified miR-29 guide strand
uagcaccauuugaaagucagug

SEQ ID NO: 121 - RNA, 23 nt, Artificial Sequence
  Modified miR-29 guide strand
uagcaccauuugaaggcaguguu

SEQ ID NO: 122 - RNA, 22 nt, Artificial Sequence
  Modified miR-29 guide strand
uagcaccaucugaaggucagug

SEQ ID NO: 123 - RNA, 21 nt, Artificial Sequence
  Modified miR-29 guide strand
uagcaccaucugaaggucagu

SEQ ID NO: 124 - RNA, 22 nt, Artificial Sequence
  Modified miR-29 guide strand
uagcaccaucugaagucagugu

SEQ ID NO: 125 - RNA, 22 nt, Artificial Sequence
  Modified miR-29 guide strand
uagcaccaucugaaagcagugu

SEQ ID NO: 126 - RNA, 21 nt, Artificial Sequence
  Modified miR-29 guide strand
uagcaccaucugaaagcagug

SEQ ID NO: 127 - RNA, 23 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorouridine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): 2'-O-methyladenosine
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  modified_base (21)..(21): gm
  misc_feature (21)..(22): methylphosphonate linkage
  modified_base (22)..(22): 2'-fluorouridine
  misc_feature (22)..(23): methylphosphonate linkage
  modified_base (23)..(23): um
uagcaccauuugaaaucaguguu

SEQ ID NO: 128 - RNA, 23 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): 2'-O-methyladenosine
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  modified_base (21)..(21): gm
  misc_feature (21)..(22): methylphosphonate linkage
  modified_base (22)..(22): 2'-fluorouridine
  misc_feature (22)..(23): methylphosphonate linkage
  modified_base (23)..(23): um
uagcaccaucugaaaucaguguu

SEQ ID NO: 129 - RNA, 23 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): gm
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  modified_base (21)..(21): gm
  misc_feature (21)..(22): methylphosphonate linkage
  modified_base (22)..(22): 2'-fluorouridine
  misc_feature (22)..(23): methylphosphonate linkage
  modified_base (23)..(23): um
uagcaccaucugaagucaguguu

SEQ ID NO: 130 - RNA, 22 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): gm
  modified_base (16)..(16): 2'-fluoroguanosine
  modified_base (17)..(17): cm
  modified_base (18)..(18): 2'-fluoroadenosine
  modified_base (19)..(19): gm
  modified_base (20)..(20): 2'-fluorouridine
  misc_feature (20)..(21): methylphosphonate linkage
  modified_base (21)..(21): gm
  misc_feature (21)..(22): methylphosphonate linkage
  modified_base (22)..(22): 2'-fluorouridine
uagcaccaucugaaggcagugu

SEQ ID NO: 131 - RNA, 22 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): gm
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  misc_feature (20)..(21): methylphosphonate linkage
  modified_base (21)..(21): gm
  misc_feature (21)..(22): methylphosphonate linkage
  modified_base (22)..(22): 2'-fluorouridine
uagcaccaucugaagucagugu

SEQ ID NO: 132 - RNA, 23 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorouridine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): 2'-O-methyladenosine
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  modified_base (21)..(21): gm
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccauuugaaaucaguguu

SEQ ID NO: 133 - RNA, 23 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): 2'-O-methyladenosine
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  modified_base (21)..(21): gm
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccaucugaaaucaguguu

SEQ ID NO: 134 - RNA, 23 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): gm
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  modified_base (21)..(21): gm
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccaucugaagucaguguu

SEQ ID NO: 135 - RNA, 22 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): gm
  modified_base (16)..(16): 2'-fluoroguanosine
  modified_base (17)..(17): cm
  modified_base (18)..(18): 2'-fluoroadenosine
  modified_base (19)..(19): gm
  modified_base (20)..(20): 2'-fluorouridine
  misc_feature (20)..(21): phosphorothioate linkage
  modified_base (21)..(21): gm
  misc_feature (21)..(22): phosphorothioate linkage
  modified_base (22)..(22): 2'-fluorouridine
uagcaccaucugaaggcagugu

SEQ ID NO: 136 - RNA, 22 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): gm
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  misc_feature (20)..(21): phosphorothioate linkage
  modified_base (21)..(21): gm
  misc_feature (21)..(22): phosphorothioate linkage
  modified_base (22)..(22): 2'-fluorouridine
uagcaccaucugaagucagugu

SEQ ID NO: 137 - RNA, 23 nt, Artificial Sequence
  Modified miR-29 guide strand
  modified_base (10)..(10): um
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): um
  modified_base (18)..(18): cm
uagcaccauuugaaggucagugu

SEQ ID NO: 138 - RNA, 23 nt, Artificial Sequence
  Modified miR-29 guide strand
  modified_base (10)..(10): um
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): um
  modified_base (18)..(18): cm
  misc_feature (21)..(22): phosphorothioate linkage
  modified_base (22)..(22): 2'-fluoroguanosine
  misc_feature (22)..(23): phosphorothioate linkage
  modified_base (23)..(23): um
uagcaccauuugaaggucagugu

SEQ ID NO: 139 - RNA, 22 nt, Artificial Sequence
  Modified miR-29 guide strand
  modified_base (10)..(10): um
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): um
uagcaccauuugaaggucagug

SEQ ID NO: 140 - RNA, 22 nt, Artificial Sequence
  Modified miR-29 guide strand
  modified_base (10)..(10): um
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uagcaccauuugaaggucagug

SEQ ID NO: 141 - RNA, 23 nt, Artificial Sequence
  Modified miR-29 guide strand
  modified_base (10)..(10): cm
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): um
  modified_base (18)..(18): cm
  misc_feature (21)..(22): phosphorothioate linkage
  modified_base (22)..(22): 2'-fluoroguanosine
  misc_feature (22)..(23): phosphorothioate linkage
  modified_base (23)..(23): um
uagcaccaucugaaggucagugu

SEQ ID NO: 142 - RNA, 22 nt, Artificial Sequence
  Modified miR-29 guide strand
  modified_base (10)..(10): cm
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uagcaccaucugaaggucagug

SEQ ID NO: 143 - RNA, 23 nt, Artificial Sequence
  Modified miR-29 guide strand
  modified_base (10)..(10): um
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): 2'-O-methyladenosine
  modified_base (16)..(16): um
  modified_base (17)..(17): cm
uagcaccauuugaaaucaguguu

SEQ ID NO: 144 - RNA, 23 nt, Artificial Sequence
  Modified miR-29 guide strand
  modified_base (10)..(10): um
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): 2'-O-methyladenosine
  modified_base (16)..(16): um
  modified_base (17)..(17): cm
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccauuugaaaucaguguu

SEQ ID NO: 145 - RNA, 23 nt, Artificial Sequence
  Modified miR-29 guide strand
  modified_base (10)..(10): cm
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): 2'-O-methyladenosine
  modified_base (16)..(16): um
  modified_base (17)..(17): cm
uagcaccaucugaaaucaguguu

SEQ ID NO: 146 - RNA, 23 nt, Artificial Sequence
  Modified miR-29 guide strand
  modified_base (10)..(10): cm
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): 2'-O-methyladenosine
  modified_base (16)..(16): um
  modified_base (17)..(17): cm
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccaucugaaaucaguguu

SEQ ID NO: 147 - RNA, 23 nt, Artificial Sequence
  Modified miR-29 guide strand
  modified_base (10)..(10): cm
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): um
  modified_base (17)..(17): cm
uagcaccaucugaagucaguguu

SEQ ID NO: 148 - RNA, 23 nt, Artificial Sequence
  Modified miR-29 guide strand
  modified_base (10)..(10): cm
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): um
  modified_base (17)..(17): cm
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccaucugaagucaguguu

SEQ ID NO: 149 - RNA, 23 nt, Artificial Sequence
  Modified miR-29 guide strand
  modified_base (10)..(10): um
  modified_base (11)..(11): 2'-fluorouridine
  modified_base (12)..(12): gm
  modified_base (13)..(13): 2'-fluoroadenosine
  modified_base (14)..(14): 2'-O-methyladenosine
  modified_base (15)..(15): 2'-fluoroadenosine
  modified_base (16)..(16): um
  modified_base (17)..(17): 2'-fluorocytidine
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccauuugaaaucaguguu

SEQ ID NO: 150 - RNA, 23 nt, Artificial Sequence
  Modified miR-29 guide strand
  modified_base (10)..(10): cm
  modified_base (11)..(11): 2'-fluorouridine
  modified_base (12)..(12): gm
  modified_base (13)..(13): 2'-fluoroadenosine
  modified_base (14)..(14): 2'-O-methyladenosine
  modified_base (15)..(15): 2'-fluoroadenosine
  modified_base (16)..(16): um
  modified_base (17)..(17): 2'-fluorocytidine
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccaucugaaaucaguguu

SEQ ID NO: 151 - RNA, 23 nt, Artificial Sequence
  Modified miR-29 guide strand
  modified_base (10)..(10): cm
  modified_base (11)..(11): 2'-fluorouridine
  modified_base (12)..(12): gm
  modified_base (13)..(13): 2'-fluoroadenosine
  modified_base (14)..(14): 2'-O-methyladenosine
  modified_base (15)..(15): 2'-fluoroguanosine
  modified_base (16)..(16): um
  modified_base (17)..(17): 2'-fluorocytidine
  misc_feature (21)..(22): phosphorothioate linkage
  modified_base (22)..(22): 2'-fluorouridine
  misc_feature (22)..(23): phosphorothioate linkage
  modified_base (23)..(23): um
uagcaccaucugaagucaguguu

SEQ ID NO: 152 - RNA, 22 nt, Artificial Sequence
  Modified miR-29 guide strand
  modified_base (10)..(10): cm
  modified_base (11)..(11): 2'-fluorouridine
  modified_base (12)..(12): gm
  modified_base (13)..(13): 2'-fluoroadenosine
  modified_base (14)..(14): 2'-O-methyladenosine
  modified_base (15)..(15): 2'-fluoroguanosine
  modified_base (16)..(16): gm
  modified_base (17)..(17): 2'-fluorocytidine
  misc_feature (20)..(21): phosphorothioate linkage
  modified_base (21)..(21): 2'-fluoroguanosine
  misc_feature (21)..(22): phosphorothioate linkage
  modified_base (22)..(22): um
uagcaccaucugaaggcagugu

SEQ ID NO: 153 - RNA, 22 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorouridine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): 2'-O-methyladenosine
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  misc_feature (20)..(21): phosphorothioate linkage
  modified_base (21)..(21): gm
  misc_feature (21)..(22): phosphorothioate linkage
  modified_base (22)..(22): 2'-fluorouridine
uagcaccauuugaaaucagugu

SEQ ID NO: 154 - RNA, 22 nt, Artificial Sequence
  Modified miR-29 guide strand
  modified_base (1)..(1): um
  modified_base (2)..(2): 2'-fluoroadenosine
  modified_base (3)..(3): gm
  modified_base (4)..(4): 2'-fluorocytidine
  modified_base (5)..(5): 2'-O-methyladenosine
  modified_base (6)..(6): 2'-fluorocytidine
  modified_base (7)..(7): cm
  modified_base (8)..(8): 2'-fluoroadenosine
  modified_base (9)..(9): um
  modified_base (10)..(10): 2'-fluorocytidine
  modified_base (11)..(11): um
  modified_base (12)..(12): 2'-fluoroguanosine
  modified_base (13)..(13): 2'-O-methyladenosine
  modified_base (14)..(14): 2'-fluoroadenosine
  modified_base (15)..(15): 2'-O-methyladenosine
  modified_base (16)..(16): 2'-fluorouridine
  modified_base (17)..(17): cm
  modified_base (18)..(18): 2'-fluoroadenosine
  modified_base (19)..(19): gm
  modified_base (20)..(20): 2'-fluorouridine
  misc_feature (20)..(21): phosphorothioate linkage
  modified_base (21)..(21): gm
  misc_feature (21)..(22): phosphorothioate linkage
  modified_base (22)..(22): 2'-fluorouridine
uagcaccaucugaaaucagugu

SEQ ID NO: 155 - RNA, 21 nt, Artificial Sequence
  Modified miR-29 passenger strand
acugauuucuuuugguguuag

SEQ ID NO: 156 - RNA, 20 nt, Artificial Sequence
  Modified miR-29 passenger strand
accgauuucuuuugguguua

SEQ ID NO: 157 - RNA, 20 nt, Artificial Sequence
  Modified miR-29 passenger strand
accgauuucagaugguguua

SEQ ID NO: 158 - RNA, 23 nt, Artificial Sequence
  Modified miR-29 passenger strand
cgcugguuucauaugguguuaga

SEQ ID NO: 159 - RNA, 22 nt, Artificial Sequence
  Modified miR-29 passenger strand
gcugguuucauauggugguuua

SEQ ID NO: 160 - RNA, 22 nt, Artificial Sequence
  Modified miR-29 passenger strand
gcugguuucagauggugguuua

SEQ ID NO: 161 - RNA, 20 nt, Artificial Sequence
  Modified miR-29 passenger strand
gcugguuucagaugguguua

SEQ ID NO: 162 - RNA, 20 nt, Artificial Sequence
  Modified miR-29 passenger strand
acugauuucagaugguguua

SEQ ID NO: 163 - RNA, 21 nt, Artificial Sequence
  Modified miR-29 passenger strand
cacugauuucagaugguguua

SEQ ID NO: 164 - RNA, 21 nt, Artificial Sequence
  Modified miR-29 passenger strand
cacugacuucagaugguguua

SEQ ID NO: 165 - RNA, 21 nt, Artificial Sequence
  Modified miR-29 passenger strand
acugacuuucagaugguguua

SEQ ID NO: 166 - RNA, 21 nt, Artificial Sequence
  Modified miR-29 passenger strand
acugaccuucagaugguguua

SEQ ID NO: 167 - RNA, 20 nt, Artificial Sequence
  Modified miR-29 passenger strand
cugacuuucagaugguguua

SEQ ID NO: 168 - RNA, 20 nt, Artificial Sequence
  Modified miR-29 passenger strand
acugcuuucagaugguguua

SEQ ID NO: 169 - RNA, 20 nt, Artificial Sequence
  Modified miR-29 passenger strand
acugacuucagaugguguua

SEQ ID NO: 170 - RNA, 22 nt, Artificial Sequence
  Modified miR-29 passenger strand
  misc_feature (1)..(1): amino C6 linker
  modified_base (1)..(1): gm
  modified_base (2)..(2): cm
  modified_base (3)..(3): um
  modified_base (20)..(20): um
  modified_base (21)..(21): um
  modified_base (22)..(22): 2'-O-methyladenosine
gcugguuucauauggugguuua

SEQ ID NO: 171 - RNA, 22 nt, Artificial Sequence
  Modified miR-29 passenger strand
  misc_feature (1)..(1): amino C6 linker
  modified_base (1)..(1): gm
  modified_base (2)..(2): cm
  modified_base (3)..(3): um
  modified_base (20)..(20): um
  modified_base (21)..(21): um
  modified_base (22)..(22): 2'-O-methyladenosine
gcugguuucagauggugguuua

SEQ ID NO: 172 - RNA, 20 nt, Artificial Sequence
  Modified miR-29 passenger strand
  misc_feature (1)..(1): amino C6 linker
  modified_base (1)..(1): gm
  modified_base (2)..(2): cm
  modified_base (3)..(3): um
  modified_base (18)..(18): um
  modified_base (19)..(19): um
  modified_base (20)..(20): 2'-O-methyladenosine
gcugguuucagaugguguua

SEQ ID NO: 173 - RNA, 20 nt, Artificial Sequence
  Modified miR-29 passenger strand
  misc_feature (1)..(1): amino C6 linker
  modified_base (1)..(1): 2'-O-methyladenosine
  modified_base (2)..(2): cm
  modified_base (3)..(3): um
  modified_base (18)..(18): um
  modified_base (19)..(19): um
  modified_base (20)..(20): 2'-O-methyladenosine
acugauuucagaugguguua

SEQ ID NO: 174 - RNA, 20 nt, Artificial Sequence
  Modified miR-29 passenger strand
  misc_feature (1)..(1): amino C6 linker
  modified_base (1)..(1): 2'-O-methyladenosine
  modified_base (2)..(2): cm
  modified_base (3)..(3): cm
  modified_base (18)..(18): um
  modified_base (19)..(19): um
  modified_base (20)..(20): 2'-O-methyladenosine
accgauuucuuuugguguua

SEQ ID NO: 175 - RNA, 20 nt, Artificial Sequence
  Modified miR-29 passenger strand
  misc_feature (1)..(1): amino C6 linker
  modified_base (1)..(1): 2'-O-methyladenosine
  modified_base (2)..(2): cm
  modified_base (3)..(3): cm
  modified_base (18)..(18): um
  modified_base (19)..(19): um
  modified_base (20)..(20): 2'-O-methyladenosine
accgauuucagaugguguua

SEQ ID NO: 176 - RNA, 21 nt, Artificial Sequence
  Modified miR-29 passenger strand
  misc_feature (1)..(1): amino C6 linker
  modified_base (1)..(1): cm
  modified_base (2)..(2): 2'-O-methyladenosine
  modified_base (3)..(3): cm
  modified_base (19)..(19): um
  modified_base (20)..(20): um
  modified_base (21)..(21): 2'-O-methyladenosine
cacugauuucagaugguguua

SEQ ID NO: 177 - RNA, 21 nt, Artificial Sequence
  Modified miR-29 passenger strand
  misc_feature (1)..(1): amino C6 linker
  modified_base (1)..(1): 2'-O-methyladenosine
  modified_base (2)..(2): cm
  modified_base (3)..(3): um
  modified_base (19)..(19): um
  modified_base (20)..(20): um
  modified_base (21)..(21): 2'-O-methyladenosine
acugacuuucagaugguguua

SEQ ID NO: 178 - RNA, 21 nt, Artificial Sequence
  Modified miR-29 passenger strand
  misc_feature (1)..(1): amino C6 linker
  modified_base (1)..(1): cm
  modified_base (2)..(2): 2'-O-methyladenosine
  modified_base (3)..(3): cm
  modified_base (19)..(19): um
  modified_base (20)..(20): um
cacugauuucagaugguguua

SEQ ID NO: 179 - RNA, 21 nt, Artificial Sequence
  Modified miR-29 passenger strand
  misc_feature (1)..(1): amino C6 linker
  modified_base (1)..(1): cm
  modified_base (2)..(2): 2'-O-methyladenosine
  modified_base (3)..(3): cm
  modified_base (19)..(19): um
  modified_base (20)..(20): um
  modified_base (21)..(21): 2'-O-methyladenosine
cacugacuucagaugguguua

SEQ ID NO: 180 - RNA, 21 nt, Artificial Sequence
  Modified miR-29 passenger strand
  misc_feature (1)..(1): amino C6 linker
  modified_base (1)..(1): 2'-O-methyladenosine
  modified_base (2)..(2): cm
  modified_base (3)..(3): um
  modified_base (19)..(19): um
  modified_base (20)..(20): um
  modified_base (21)..(21): 2'-O-methyladenosine
acugaccuucagaugguguua

SEQ ID NO: 181 - RNA, 20 nt, Artificial Sequence
  Modified miR-29 passenger strand
  misc_feature (1)..(1): amino C6 linker
  modified_base (1)..(1): cm
  modified_base (2)..(2): um
  modified_base (3)..(3): gm
  modified_base (18)..(18): um
  modified_base (19)..(19): um
  modified_base (20)..(20): 2'-O-methyladenosine
cugacuuucagaugguguua

SEQ ID NO: 182 - RNA, 20 nt, Artificial Sequence
  Modified miR-29 passenger strand
  misc_feature (1)..(1): amino C6 linker
  modified_base (1)..(1): 2'-O-methyladenosine
  modified_base (2)..(2): cm
  modified_base (3)..(3): um
  modified_base (18)..(18): um
  modified_base (19)..(19): um
  modified_base (20)..(20): 2'-O-methyladenosine
acugcuuucagaugguguua

SEQ ID NO: 183 - RNA, 20 nt, Artificial Sequence
  Modified miR-29 passenger strand
  misc_feature (1)..(1): amino C6 linker
  modified_base (1)..(1): 2'-O-methyladenosine
  modified_base (2)..(2): cm
  modified_base (3)..(3): um
  modified_base (18)..(18): um
  modified_base (19)..(19): um
  modified_base (20)..(20): 2'-O-methyladenosine
acugacuucagaugguguua

SEQ ID NO: 184 - RNA, 22 nt, Artificial Sequence
  Modified miR-26 guide strand
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  modified_base (18)..(18): 2'-O-methyladenosine
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 185 - RNA, 21 nt, Artificial Sequence
  Modified miR-26 guide strand
  modified_base (11)..(11): um
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 186 - RNA, 22 nt, Artificial Sequence
  Modified miR-26 Guide strand
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 187 - RNA, 22 nt, Artificial Sequence
  Modified miR-26 Guide strand
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 188 - RNA, 22 nt, Artificial Sequence
  Modified miR-26 Guide strand
  modified_base (10)..(10): um
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  modified_base (18)..(18): 2'-O-methyladenosine
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 189 - RNA, 22 nt, Artificial Sequence
  Modified miR-26 Guide strand
  modified_base (10)..(10): um
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 190 - RNA, 22 nt, Artificial Sequence
  Modified miR-26 Guide strand
  modified_base (10)..(10): um
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 191 - RNA, 22 nt, Artificial Sequence
  Modified miR-26 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  modified_base (18)..(18): 2'-O-methyladenosine
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 192 - RNA, 22 nt, Artificial Sequence
  Modified miR-26 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 193 - RNA, 22 nt, Artificial Sequence
  Modified miR-26 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  misc_feature (20)..(21): phosphorothioate linkage
  modified_base (21)..(21): 2'-fluorocytidine
  misc_feature (21)..(22): phosphorothioate linkage
  modified_base (22)..(22): um
uucaaguaauccaggauaggcu

SEQ ID NO: 194 - RNA, 21 nt, Artificial Sequence
  Modified miR-26 Guide strand
  modified_base (11)..(11): um
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 195 - RNA, 21 nt, Artificial Sequence
  Modified miR-26 Guide strand
  modified_base (11)..(11): um
  modified_base (12)..(12): cm
  modified_base (13)..(13): 2'-O-methyladenosine
  modified_base (14)..(14): gm
  modified_base (15)..(15): gm
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 196 - RNA, 21 nt, Artificial Sequence
  Modified miR-26 Guide strand
  modified_base (10)..(10): um
  modified_base (11)..(11): um
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 197 - RNA, 21 nt, Artificial Sequence
  Modified miR-26 Guide strand
  modified_base (10)..(10): um
  modified_base (11)..(11): um
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 198 - RNA, 21 nt, Artificial Sequence
  Modified miR-26 Guide strand
  modified_base (10)..(10): um
  modified_base (11)..(11): um
  modified_base (12)..(12): cm
  modified_base (13)..(13): 2'-O-methyladenosine
  modified_base (14)..(14): gm
  modified_base (15)..(15): gm
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 199 - RNA, 21 nt, Artificial Sequence
  Modified miR-26 Guide strand
  modified_base (9)..(9): 2'-O-methyladenosine
  modified_base (10)..(10): um
  modified_base (11)..(11): um
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  modified_base (17)..(17): um
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 200 - RNA, 21 nt, Artificial Sequence
  Modified miR-26 Guide strand
  modified_base (9)..(9): 2'-O-methyladenosine
  modified_base (10)..(10): um
  modified_base (11)..(11): um
  modified_base (12)..(12): cm
  modified_base (13)..(13): 2'-O-methyladenosine
  modified_base (14)..(14): gm
  modified_base (15)..(15): gm
  modified_base (16)..(16): 2'-O-methyladenosine
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 201 - RNA, 21 nt, Artificial Sequence
  Modified miR-26 Guide strand
  modified_base (9)..(9): 2'-O-methyladenosine
  modified_base (10)..(10): um
  modified_base (11)..(11): um
  modified_base (12)..(12): cm
  modified_base (13)..(13): 2'-O-methyladenosine
  modified_base (14)..(14): gm
  modified_base (15)..(15): gm
  misc_feature (19)..(20): phosphorothioate linkage
  modified_base (20)..(20): 2'-fluoroguanosine
  misc_feature (20)..(21): phosphorothioate linkage
  modified_base (21)..(21): um
uucaaguaauucaggauaggu

SEQ ID NO: 202 - RNA, 22 nt, Artificial Sequence
  Modified miR-26 passenger strand
  misc_feature (1)..(1): amino C6 linker
  modified_base (1)..(1): cm
  modified_base (2)..(2): cm
  modified_base (3)..(3): um
  modified_base (20)..(20): 2'-O-methyladenosine
  modified_base (21)..(21): cm
  modified_base (22)..(22): gm
ccuauucuugguuacuugcacg

SEQ ID NO: 203 - RNA, 22 nt, Artificial Sequence
  Modified miR-26 passenger strand
  misc_feature (1)..(1): amino C6 linker
  modified_base (1)..(1): cm
  modified_base (2)..(2): cm
  modified_base (3)..(3): um
  modified_base (20)..(20): um
  modified_base (21)..(21): um
  modified_base (22)..(22): cm
ccuauucuugauuacuuguuuc

SEQ ID NO: 204 - RNA, 22 nt, Artificial Sequence
  Modified miR-26 passenger strand
  misc_feature (1)..(1): amino C6 linker
  modified_base (1)..(1): cm
  modified_base (2)..(2): cm
  modified_base (3)..(3): um
  modified_base (20)..(20): cm
  modified_base (21)..(21): um
  modified_base (22)..(22): cm
ccuguucuccauuacuuggcuc

SEQ ID NO: 205 - RNA, 22 nt, Artificial Sequence
  Modified miR-27 Guide strand
  modified_base (11)..(11): um
  modified_base (12)..(12): gm
  modified_base (13)..(13): cm
  modified_base (14)..(14): um
  modified_base (15)..(15): um
  modified_base (16)..(16): gm
  modified_base (17)..(17): um
  modified_base (18)..(18): gm
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 206 - RNA, 22 nt, Artificial Sequence
  Modified miR-27 Guide strand
  modified_base (11)..(11): um
  modified_base (12)..(12): gm
  modified_base (13)..(13): cm
  modified_base (14)..(14): um
  modified_base (15)..(15): um
  modified_base (16)..(16): gm
  modified_base (17)..(17): um
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 207 - RNA, 22 nt, Artificial Sequence
  Modified miR-27 Guide strand
  modified_base (11)..(11): um
  modified_base (12)..(12): gm
  modified_base (13)..(13): cm
  modified_base (14)..(14): um
  modified_base (15)..(15): um
  modified_base (16)..(16): gm
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 208 - RNA, 22 nt, Artificial Sequence
  Modified miR-27 Guide strand
  modified_base (10)..(10): cm
  modified_base (11)..(11): um
  modified_base (12)..(12): gm
  modified_base (13)..(13): cm
  modified_base (14)..(14): um
  modified_base (15)..(15): um
  modified_base (16)..(16): gm
  modified_base (17)..(17): um
  modified_base (18)..(18): gm
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 209 - RNA, 22 nt, Artificial Sequence
  Modified miR-27 Guide strand
  modified_base (10)..(10): cm
  modified_base (11)..(11): um
  modified_base (12)..(12): gm
  modified_base (13)..(13): cm
  modified_base (14)..(14): um
  modified_base (15)..(15): um
  modified_base (16)..(16): gm
  modified_base (17)..(17): um
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 210 - RNA, 22 nt, Artificial Sequence
  Modified miR-27 Guide strand
  modified_base (10)..(10): cm
  modified_base (11)..(11): um
  modified_base (12)..(12): gm
  modified_base (13)..(13): cm
  modified_base (14)..(14): um
  modified_base (15)..(15): um
  modified_base (16)..(16): gm
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 211 - RNA, 22 nt, Artificial Sequence
  Modified miR-27 Guide strand
  modified_base (9)..(9): gm
  modified_base (10)..(10): cm
  modified_base (11)..(11): um
  modified_base (12)..(12): gm
  modified_base (13)..(13): cm
  modified_base (14)..(14): um
  modified_base (15)..(15): um
  modified_base (16)..(16): gm
  modified_base (17)..(17): um
  modified_base (18)..(18): gm
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 212 - RNA, 22 nt, Artificial Sequence
  Modified miR-27 Guide strand
  modified_base (9)..(9): gm
  modified_base (10)..(10): cm
  modified_base (11)..(11): um
  modified_base (12)..(12): gm
  modified_base (13)..(13): cm
  modified_base (14)..(14): um
  modified_base (15)..(15): um
  modified_base (16)..(16): gm
  modified_base (17)..(17): um
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 213 - RNA, 22 nt, Artificial Sequence
  Modified miR-27 Guide strand
  modified_base (9)..(9): gm
  modified_base (10)..(10): cm
  modified_base (11)..(11): um
  modified_base (12)..(12): gm
  modified_base (13)..(13): cm
  modified_base (14)..(14): um
  modified_base (15)..(15): um
  modified_base (16)..(16): gm
  misc_feature (20)..(21): phosphorothioate linkage
  modified_base (21)..(21): 2'-fluorocytidine
  misc_feature (21)..(22): phosphorothioate linkage
  modified_base (22)..(22): 2'-O-methyladenosine
agggcuuagcugcuugugagca

SEQ ID NO: 214 - RNA, 22 nt, Artificial Sequence
  Modified miR-27 Guide strand
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  modified_base (17)..(17): gm
  modified_base (18)..(18): um
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 215 - RNA, 22 nt, Artificial Sequence
  Modified miR-27 Guide strand
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  modified_base (17)..(17): gm
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 216 - RNA, 22 nt, Artificial Sequence
  Modified miR-27 Guide strand
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 217 - RNA, 22 nt, Artificial Sequence
  Modified miR-27 Guide strand
  modified_base (10)..(10): cm
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  modified_base (17)..(17): gm
  modified_base (18)..(18): um
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 218 - RNA, 22 nt, Artificial Sequence
  Modified miR-27 Guide strand
  modified_base (10)..(10): cm
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  modified_base (17)..(17): gm
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 219 - RNA, 22 nt, Artificial Sequence
  Modified miR-27 Guide strand
  modified_base (10)..(10): cm
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 220 - RNA, 22 nt, Artificial Sequence
  Modified miR-27 Guide strand
  modified_base (9)..(9): gm
  modified_base (10)..(10): cm
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  modified_base (17)..(17): gm
  modified_base (18)..(18): um
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 221 - RNA, 22 nt, Artificial Sequence
  Modified miR-27 Guide strand
  modified_base (9)..(9): gm
  modified_base (10)..(10): cm
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  modified_base (17)..(17): gm
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 222 - RNA, 22 nt, Artificial Sequence
  Modified miR-27 Guide strand
  modified_base (9)..(9): gm
  modified_base (10)..(10): cm
  modified_base (11)..(11): um
  modified_base (12)..(12): gm
  modified_base (13)..(13): 2'-O-methyladenosine
  modified_base (14)..(14): um
  modified_base (15)..(15): um
  modified_base (16)..(16): gm
  misc_feature (20)..(21): phosphorothioate linkage
  modified_base (21)..(21): 2'-fluoroadenosine
  misc_feature (21)..(22): phosphorothioate linkage
  modified_base (22)..(22): cm
agagcuuagcugauuggugaac

SEQ ID NO: 223 - RNA, 21 nt, Artificial Sequence
  Modified miR-27 Passenger strand
  misc_feature (1)..(1): amino C6 linker
  modified_base (1)..(1): um
  modified_base (2)..(2): um
  modified_base (3)..(3): cm
  modified_base (19)..(19): cm
  modified_base (20)..(20): gm
  modified_base (21)..(21): cm
uucacaguggcuaaguuccgc

SEQ ID NO: 224 - RNA, 21 nt, Artificial Sequence
  Modified miR-27 Passenger strand
  misc_feature (1)..(1): amino C6 linker
  modified_base (1)..(1): um
  modified_base (2)..(2): um
  modified_base (3)..(3): cm
  modified_base (19)..(19): um
  modified_base (20)..(20): gm
  modified_base (21)..(21): cm
uucacaguggcuaaguucugc

SEQ ID NO: 225 - RNA, 21 nt, Artificial Sequence
  Modified miR-101 Guide strand
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  modified_base (16)..(16): 2'-O-methyladenosine
  modified_base (17)..(17): cm
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 226 - RNA, 21 nt, Artificial Sequence
  Modified miR-101 Guide strand
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  modified_base (16)..(16): 2'-O-methyladenosine
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 227 - RNA, 21 nt, Artificial Sequence
  Modified miR-101 Guide strand
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 228 - RNA, 21 nt, Artificial Sequence
  Modified miR-101 Guide strand
  modified_base (10)..(10): gm
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  modified_base (16)..(16): 2'-O-methyladenosine
  modified_base (17)..(17): cm
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 229 - RNA, 21 nt, Artificial Sequence
  Modified miR-101 Guide strand
  modified_base (10)..(10): gm
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  modified_base (16)..(16): 2'-O-methyladenosine
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 230 - RNA, 21 nt, Artificial Sequence
  Modified miR-101 Guide strand
  modified_base (10)..(10): gm
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 231 - RNA, 21 nt, Artificial Sequence
  Modified miR-101 Guide strand
  modified_base (9)..(9): um
  modified_base (10)..(10): gm
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  modified_base (16)..(16): 2'-O-methyladenosine
  modified_base (17)..(17): cm
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 232 - RNA, 21 nt, Artificial Sequence
  Modified miR-101 Guide strand
  modified_base (9)..(9): um
  modified_base (10)..(10): gm
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  modified_base (16)..(16): 2'-O-methyladenosine
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 233 - RNA, 21 nt, Artificial Sequence
  Modified miR-101 Guide strand
  modified_base (9)..(9): um
  modified_base (10)..(10): gm
  modified_base (11)..(11): um
  modified_base (12)..(12): gm
  modified_base (13)..(13): 2'-O-methyladenosine
  modified_base (14)..(14): um
  modified_base (15)..(15): 2'-O-methyladenosine
  misc_feature (19)..(20): phosphorothioate linkage
  modified_base (20)..(20): 2'-fluoroadenosine
  misc_feature (20)..(21): phosphorothioate linkage
  modified_base (21)..(21): 2'-O-methyladenosine
uacaguacugugauaacugaa

SEQ ID NO: 234 - RNA, 22 nt, Artificial Sequence
  Modified miR-101 Passenger strand
  misc_feature (1)..(1): amino C6 linker
  modified_base (1)..(1): cm
  modified_base (2)..(2): 2'-O-methyladenosine
  modified_base (3)..(3): gm
  modified_base (20)..(20): gm
  modified_base (21)..(21): cm
  modified_base (22)..(22): um
caguuaucacagugcugaugcu

SEQ ID NO: 235 - RNA, 23 nt, Artificial Sequence
  Modified miR-145 Guide strand
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  modified_base (18)..(18): 2'-O-methyladenosine
  modified_base (19)..(19): um
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 236 - RNA, 23 nt, Artificial Sequence
  Modified miR-145 Guide strand
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 237 - RNA, 23 nt, Artificial Sequence
  Modified miR-145 Guide strand
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 238 - RNA, 23 nt, Artificial Sequence
  Modified miR-145 Guide strand
  modified_base (10)..(10): um
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  modified_base (18)..(18): 2'-O-methyladenosine
  modified_base (19)..(19): um
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 239 - RNA, 23 nt, Artificial Sequence
  Modified miR-145 Guide strand
  modified_base (10)..(10): um
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 240 - RNA, 23 nt, Artificial Sequence
  Modified miR-145 Guide strand
  modified_base (10)..(10): um
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 241 - RNA, 23 nt, Artificial Sequence
  Modified miR-145 Guide strand
  modified_base (9)..(9): um
  modified_base (10)..(10): um
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  modified_base (18)..(18): 2'-O-methyladenosine
  modified_base (19)..(19): um
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 242 - RNA, 23 nt, Artificial Sequence
  Modified miR-145 Guide strand
  modified_base (9)..(9): um
  modified_base (10)..(10): um
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 243 - RNA, 23 nt, Artificial Sequence
  Modified miR-145 Guide strand
  modified_base (9)..(9): um
  modified_base (10)..(10): um
  modified_base (11)..(11): cm
  modified_base (12)..(12): cm
  modified_base (13)..(13): cm
  modified_base (14)..(14): 2'-O-methyladenosine
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
guccaguuuucccaggaaucccu

SEQ ID NO: 244 - RNA, 22 nt, Artificial Sequence
  Modified miR-145 Passenger strand
  misc_feature (1)..(1): amino C6 linker
  modified_base (1)..(1): gm
  modified_base (2)..(2): gm
  modified_base (3)..(3): 2'-O-methyladenosine
  modified_base (20)..(20): um
  modified_base (21)..(21): cm
  modified_base (22)..(22): um
ggauuccuggaaauacuguucu

SEQ ID NO: 245 - RNA, 22 nt, Artificial Sequence
  Modified miR-205 guide strand
uccuucauaccaccggagugug

SEQ ID NO: 246 - RNA, 23 nt, Artificial Sequence
  Modified miR-205 guide strand
uccuucauacccaccggagucug

SEQ ID NO: 247 - RNA, 22 nt, Artificial Sequence
  Modified miR-205 guide strand
uccuucauaccuccggagucug

SEQ ID NO: 248 - RNA, 22 nt, Artificial Sequence
  Modified miR-205 guide strand
uccuucauaccuccggagugug

SEQ ID NO: 249 - RNA, 23 nt, Artificial Sequence
  Modified miR-205 guide strand
uccuucauauccaccggagugcu

SEQ ID NO: 250 - RNA, 23 nt, Artificial Sequence
  Modified miR-205 guide strand
uccuucauauccaccggagugug

SEQ ID NO: 251 - RNA, 23 nt, Artificial Sequence
  Modified miR-205 guide strand
uccuucauauccuccggagugcu

SEQ ID NO: 252 - RNA, 23 nt, Artificial Sequence
  Modified miR-205 guide strand
uccuucauauccuccggagugug

SEQ ID NO: 253 - RNA, 22 nt, Artificial Sequence
  Modified miR-205 guide strand
uccuucaucccaccggagugug

SEQ ID NO: 254 - RNA, 22 nt, Artificial Sequence
  Modified miR-205 guide strand
uccuucaucccuccggagucug

SEQ ID NO: 255 - RNA, 22 nt, Artificial Sequence
  Modified miR-205 guide strand
uccuucaucccuccggagugug

SEQ ID NO: 256 - RNA, 23 nt, Artificial Sequence
  Modified miR-205 guide strand
uccuucaucuccaccggagugcu

SEQ ID NO: 257 - RNA, 23 nt, Artificial Sequence
  Modified miR-205 guide strand
uccuucaucuccaccggagugug

SEQ ID NO: 258 - RNA, 23 nt, Artificial Sequence
  Modified miR-205 guide strand
uccuucaucuccuccggagugcu

SEQ ID NO: 259 - RNA, 23 nt, Artificial Sequence
  Modified miR-205 guide strand
uccuucauuccaccggagugcug

SEQ ID NO: 260 - RNA, 22 nt, Artificial Sequence
  Modified miR-205 guide strand
uccuucauuccaccggagugug

SEQ ID NO: 261 - RNA, 23 nt, Artificial Sequence
  Modified miR-205 guide strand
uccuucauuccaucggagugcug

SEQ ID NO: 262 - RNA, 22 nt, Artificial Sequence
  Modified miR-205 guide strand
uccuucauuccuccggagucug

SEQ ID NO: 263 - RNA, 22 nt, Artificial Sequence
  Modified miR-205 guide strand
uccuucauuccuccggagugug

SEQ ID NO: 264 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 265 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 266 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 267 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 268 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 269 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 270 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 271 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 272 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagucug

SEQ ID NO: 273 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 274 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 275 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 276 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 277 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 278 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 279 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 280 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 281 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccaccggagugug

SEQ ID NO: 282 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 283 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 284 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 285 - RNA, 23 nt, Artificial Sequence
  Modified miR-205 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 286 - RNA, 23 nt, Artificial Sequence
  Modified miR-205 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 287 - RNA, 23 nt, Artificial Sequence
  Modified miR-205 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 288 - RNA, 23 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 289 - RNA, 23 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 290 - RNA, 23 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauacccaccggagucug

SEQ ID NO: 291 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 292 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 293 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 294 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 295 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 296 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 297 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 298 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 299 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagucug

SEQ ID NO: 300 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 301 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 302 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 303 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 304 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 305 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 306 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 307 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 308 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauaccuccggagugug

SEQ ID NO: 309 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 310 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 311 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 312 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 313 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 314 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 315 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 316 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 317 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccaccggagugcu

SEQ ID NO: 318 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 319 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 320 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 321 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 322 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 323 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 324 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 325 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 326 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccaccggagugug

SEQ ID NO: 327 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 328 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 329 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 330 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 331 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 332 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 333 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 334 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 335 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucauauccuccggagugcu

SEQ ID NO: 336 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 337 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 338 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 339 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 340 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 341 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 342 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 343 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 344 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauauccuccggagugug

SEQ ID NO: 345 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 346 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 347 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 348 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 349 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 350 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 351 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 352 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 353 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccaccggagugug

SEQ ID NO: 354 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 355 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 356 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 357 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 358 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 359 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 360 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 361 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 362 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagucug

SEQ ID NO: 363 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 364 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 365 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 366 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 367 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 368 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 369 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 370 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 371 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucaucccuccggagugug

SEQ ID NO: 372 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 373 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 374 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 375 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 376 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 377 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 378 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 379 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 380 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccaccggagugcu

SEQ ID NO: 381 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 382 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 383 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 384 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 385 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 386 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 387 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 388 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 389 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucaucuccaccggagugug

SEQ ID NO: 390 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 391 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 392 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 393 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 394 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 395 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 396 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 397 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 398 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  misc_feature (21)..(22): phosphorothioate linkage
  modified_base (22)..(22): 2'-fluorocytidine
  misc_feature (22)..(23): phosphorothioate linkage
  modified_base (23)..(23): um
uccuucaucuccuccggagugcu

SEQ ID NO: 399 - RNA, 23 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (19)..(19): um
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 400 - RNA, 23 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 401 - RNA, 23 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 402 - RNA, 23 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (19)..(19): um
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 403 - RNA, 23 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 404 - RNA, 23 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 405 - RNA, 23 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (19)..(19): um
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 406 - RNA, 23 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 407 - RNA, 23 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaccggagugcug

SEQ ID NO: 408 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 409 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 410 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 411 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 412 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 413 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 414 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 415 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 416 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccaccggagugug

SEQ ID NO: 417 - RNA, 23 nt, Artificial Sequence
  Modified miR-205 Guide strand
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (19)..(19): um
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 418 - RNA, 23 nt, Artificial Sequence
  Modified miR-205 Guide strand
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 419 - RNA, 23 nt, Artificial Sequence
  Modified miR-205 Guide strand
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 420 - RNA, 23 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (19)..(19): um
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 421 - RNA, 23 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 422 - RNA, 23 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 423 - RNA, 23 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (19)..(19): um
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 424 - RNA, 23 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 425 - RNA, 23 nt, Artificial Sequence
  Modified miR-205 Guide strand
  modified_base (9)..(9): um
  modified_base (10)..(10): cm
  modified_base (11)..(11): cm
  modified_base (12)..(12): 2'-O-methyladenosine
  modified_base (13)..(13): um
  modified_base (14)..(14): cm
  modified_base (15)..(15): gm
  modified_base (16)..(16): gm
  modified_base (17)..(17): 2'-O-methyladenosine
  misc_feature (21)..(22): phosphorothioate linkage
  modified_base (22)..(22): 2'-fluorouridine
  misc_feature (22)..(23): phosphorothioate linkage
  modified_base (23)..(23): gm
uccuucauuccaucggagugcug

SEQ ID NO: 426 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 427 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 428 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 429 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 430 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 431 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 432 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 433 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 434 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagucug

SEQ ID NO: 435 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 436 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 437 - RNA, 22 nt, Artificial Sequence
  Modified miR-205 Guide strand
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 438 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 439 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 440 - RNA, 22 nt, Artificial Sequence
  Modified miR-205 Guide strand
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 441 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 442 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  modified_base (17)..(17): 2'-O-methyladenosine
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 443 - RNA, 22 nt, Artificial Sequence
  Modified miR-205 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): cm
  modified_base (15)..(15): gm
  modified_base (16)..(16): gm
  misc_feature (20)..(21): phosphorothioate linkage
  modified_base (21)..(21): 2'-fluorouridine
  misc_feature (21)..(22): phosphorothioate linkage
  modified_base (22)..(22): gm
uccuucauuccuccggagugug

SEQ ID NO: 444 - RNA, 21 nt, Artificial Sequence
  Modified miR-205 Passenger strand
  misc_feature (1)..(1): amino C6 linker
  modified_base (1)..(1): gm
  modified_base (2)..(2): 2'-O-methyladenosine
  modified_base (3)..(3): um
  modified_base (19)..(19): um
  modified_base (20)..(20): um
  modified_base (21)..(21): cm
gauuucaguggagugaaguuc

SEQ ID NO: 445 - RNA, 22 nt, Artificial Sequence
  Modified miR-338 Guide strand
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  modified_base (17)..(17): um
  modified_base (18)..(18): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 446 - RNA, 22 nt, Artificial Sequence
  Modified miR-338 Guide strand
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  modified_base (17)..(17): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 447 - RNA, 22 nt, Artificial Sequence
  Modified miR-338 Guide strand
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 448 - RNA, 22 nt, Artificial Sequence
  Modified miR-338 Guide strand
  modified_base (10)..(10): 2'-O-methyladenosine
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  modified_base (17)..(17): um
  modified_base (18)..(18): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 449 - RNA, 22 nt, Artificial Sequence
  Modified miR-338 Guide strand
  modified_base (10)..(10): 2'-O-methyladenosine
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  modified_base (17)..(17): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 450 - RNA, 22 nt, Artificial Sequence
  Modified miR-338 Guide strand
  modified_base (10)..(10): 2'-O-methyladenosine
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 451 - RNA, 22 nt, Artificial Sequence
  Modified miR-338 Guide strand
  modified_base (9)..(9): cm
  modified_base (10)..(10): 2'-O-methyladenosine
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  modified_base (17)..(17): um
  modified_base (18)..(18): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 452 - RNA, 22 nt, Artificial Sequence
  Modified miR-338 Guide strand
  modified_base (9)..(9): cm
  modified_base (10)..(10): 2'-O-methyladenosine
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  modified_base (17)..(17): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 453 - RNA, 22 nt, Artificial Sequence
  Modified miR-338 Guide strand
  modified_base (9)..(9): cm
  modified_base (10)..(10): 2'-O-methyladenosine
  modified_base (11)..(11): gm
  modified_base (12)..(12): um
  modified_base (13)..(13): gm
  modified_base (14)..(14): 2'-O-methyladenosine
  modified_base (15)..(15): um
  modified_base (16)..(16): um
  misc_feature (20)..(21): phosphorothioate linkage
  modified_base (21)..(21): 2'-fluorouridine
  misc_feature (21)..(22): phosphorothioate linkage
  modified_base (22)..(22): gm
uccagcaucagugauuuuguug

SEQ ID NO: 454 - RNA, 22 nt, Artificial Sequence
  Modified miR-338 Passenger strand
  misc_feature (1)..(1): amino C6 linker
  modified_base (1)..(1): 2'-O-methyladenosine
  modified_base (2)..(2): 2'-O-methyladenosine
  modified_base (3)..(3): cm
  modified_base (20)..(20): gm
  modified_base (21)..(21): um
  modified_base (22)..(22): gm
aacaauauccuggugcugagug

SEQ ID NO: 455 - RNA, 22 nt, Artificial Sequence
  Modified miR-375 Guide strand
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  modified_base (17)..(17): gm
  modified_base (18)..(18): cm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 456 - RNA, 22 nt, Artificial Sequence
  Modified miR-375 Guide strand
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  modified_base (17)..(17): gm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 457 - RNA, 22 nt, Artificial Sequence
  Modified miR-375 Guide strand
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 458 - RNA, 22 nt, Artificial Sequence
  Modified miR-375 Guide strand
  modified_base (10)..(10): um
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  modified_base (17)..(17): gm
  modified_base (18)..(18): cm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 459 - RNA, 22 nt, Artificial Sequence
  Modified miR-375 Guide strand
  modified_base (10)..(10): um
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  modified_base (17)..(17): gm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 460 - RNA, 22 nt, Artificial Sequence
  Modified miR-375 Guide strand
  modified_base (10)..(10): um
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 461 - RNA, 22 nt, Artificial Sequence
  Modified miR-375 Guide strand
  modified_base (9)..(9): um
  modified_base (10)..(10): um
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  modified_base (17)..(17): gm
  modified_base (18)..(18): cm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 462 - RNA, 22 nt, Artificial Sequence
  Modified miR-375 Guide strand
  modified_base (9)..(9): um
  modified_base (10)..(10): um
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  modified_base (17)..(17): gm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 463 - RNA, 22 nt, Artificial Sequence
  Modified miR-375 Guide strand
  modified_base (9)..(9): um
  modified_base (10)..(10): um
  modified_base (11)..(11): cm
  modified_base (12)..(12): gm
  modified_base (13)..(13): gm
  modified_base (14)..(14): cm
  modified_base (15)..(15): um
  modified_base (16)..(16): cm
  misc_feature (20)..(21): phosphorothioate linkage
  modified_base (21)..(21): 2'-fluoroguanosine
  misc_feature (21)..(22): phosphorothioate linkage
  modified_base (22)..(22): 2'-O-methyladenosine
uuuguucguucggcucgcguga

SEQ ID NO: 464 - RNA, 23 nt, Artificial Sequence
  Modified miR-375 Passenger strand
  misc_feature (1)..(1): amino C6 linker
  modified_base (1)..(1): gm
  modified_base (2)..(2): cm
  modified_base (3)..(3): gm
  modified_base (21)..(21): 2'-O-methyladenosine
  modified_base (22)..(22): cm
  modified_base (23)..(23): cm
gcgacgagccccucgcacaaacc

SEQ ID NO: 465 - RNA, 21 nt, Artificial Sequence
  Engineered miR guide strand
uugagaaggaggcugcugaga

SEQ ID NO: 466 - RNA, 18 nt, Artificial Sequence
  Engineered miR passenger strand
ucagcagccuccuucuaa

SEQ ID NO: 467 - RNA, 32 nt, Homo sapiens
auucuuagucacaaaauauauuuuguuuacaa

SEQ ID NO: 468 - RNA, 28 nt, Homo sapiens
auuuuggaguguaggugacuuguuuacu

SEQ ID NO: 469 - RNA, 33 nt, Homo sapiens
uagacccacagacugguuuugcaacguuuacac

SEQ ID NO: 470 - RNA, 24 nt, Human immunodeficiency virus type 1
uccacugaccuuuggauggugcua

SEQ ID NO: 471 - RNA, 18 nt, Homo sapiens
ucacucaguuuggugcuu

SEQ ID NO: 472 - RNA, 23 nt, Homo sapiens
acucuacacagcuucuggugcuu

SEQ ID NO: 473 - RNA, 23 nt, Homo sapiens
guauggaaaaccuaauggugcuu

SEQ ID NO: 474 - RNA, 31 nt, severe acute respiratory syndrome coronavirus
cucauggaaagugaacuugucauuggugcug

SEQ ID NO: 475 - RNA, 31 nt, severe acute respiratory syndrome coronavirus
uccuucccacaagcagccccgcaugguguug

SEQ ID NO: 476 - RNA, 31 nt, severe acute respiratory syndrome coronavirus
acugccacugcuggauggacauuuggugcug

SEQ ID NO: 477 - RNA, 31 nt, severe acute respiratory syndrome coronavirus
auuguggcuuauacuaugucuuuaggugcug

SEQ ID NO: 478 - RNA, 31 nt, severe acute respiratory syndrome coronavirus
agacaaauagcgccaggacaaacugguguua

SEQ ID NO: 479 - RNA, 31 nt, severe acute respiratory syndrome coronavirus
uacaacaugagaguuauucacuuuggugcug

SEQ ID NO: 480 - RNA, 31 nt, severe acute respiratory syndrome coronavirus
gaccuuuuuagaaacgcccguaaugguguuu

SEQ ID NO: 481 - RNA, 31 nt, severe acute respiratory syndrome coronavirus
uguauuacacgaugcaauuuagguggugcug

SEQ ID NO: 482 - RNA, 31 nt, severe acute respiratory syndrome coronavirus
acacaucacgauaaauucacugaugguguuu

SEQ ID NO: 483 - RNA, 31 nt, severe acute respiratory syndrome coronavirus
ccacauacagucuugcaggcuguaggugcuu

SEQ ID NO: 484 - RNA, 31 nt, severe acute respiratory syndrome coronavirus
cuaguaagaaaaauauuuguagaugguguuc

SEQ ID NO: 485 - RNA, 31 nt, severe acute respiratory syndrome coronavirus
aacauggaccaagaguccuuugguggugcuu

SEQ ID NO: 486 - RNA, 31 nt, severe acute respiratory syndrome coronavirus
cuuaaacaaccuaaauagagguauggugcug

SEQ ID NO: 487 - RNA, 31 nt, severe acute respiratory syndrome coronavirus
uugucuguuuugcuauccaugcagggugcug

SEQ ID NO: 488 - RNA, 31 nt, severe acute respiratory syndrome coronavirus
aaccguuacuucaggcuuacucuugguguuu

SEQ ID NO: 489 - RNA, 31 nt, severe acute respiratory syndrome coronavirus
uuugauguuguuagacaaugcucugguguua

SEQ ID NO: 490 - RNA, 31 nt, severe acute respiratory syndrome coronavirus
gcaugcuacaaugguucaccaucugguguuu

SEQ ID NO: 491 - RNA, 31 nt, severe acute respiratory syndrome coronavirus
gcucuaaaugacuuuagcaacucaggugcug

SEQ ID NO: 492 - RNA, 31 nt, severe acute respiratory syndrome coronavirus
uuuacuccucuugugcaaccugugggugcuu

SEQ ID NO: 493 - RNA, 31 nt, severe acute respiratory syndrome coronavirus
uuugguguacucuuaucuaauuuuggugcuc

SEQ ID NO: 494 - RNA, 31 nt, severe acute respiratory syndrome coronavirus
agacaacguucaaaccaaacacuugguguuu

SEQ ID NO: 495 - RNA, 31 nt, severe acute respiratory syndrome coronavirus
cacuauucagcgaguuucaagaaaggugcua

SEQ ID NO: 496 - RNA, 31 nt, severe acute respiratory syndrome coronavirus
caguuugguccaacauacuuggauggugcug

SEQ ID NO: 497 - RNA, 31 nt, severe acute respiratory syndrome coronavirus
ccauuguugucagcaggcauauuuggugcua

SEQ ID NO: 498 - RNA, 31 nt, severe acute respiratory syndrome coronavirus
ugugguuuucccucacaggcugcugguguua

SEQ ID NO: 499 - RNA, 31 nt, severe acute respiratory syndrome coronavirus
guuaccaagggaaagcccguaaaaggugcuu

SEQ ID NO: 500 - RNA, 31 nt, severe acute respiratory syndrome coronavirus 2
gggccagaagcuggacuucccuauggugcua

SEQ ID NO: 501 - RNA, 31 nt, severe acute respiratory syndrome coronavirus 2
ucaacucaauugaguacagacacugguguug

SEQ ID NO: 502 - RNA, 31 nt, severe acute respiratory syndrome coronavirus 2
acuucugguuggaccuuuggugcaggugcug

SEQ ID NO: 503 - RNA, 31 nt, severe acute respiratory syndrome coronavirus 2
ucauaugguuuccaacccacuaaugguguug

SEQ ID NO: 504 - RNA, 31 nt, severe acute respiratory syndrome coronavirus 2
caggccgguagcacaccuuguaaugguguug

SEQ ID NO: 505 - RNA, 31 nt, severe acute respiratory syndrome coronavirus 2
gauucuucuucagguuggacagcuggugcug

SEQ ID NO: 506 - RNA, 31 nt, severe acute respiratory syndrome coronavirus 2
aacccuguccuaccauuuaaugaugguguuu

SEQ ID NO: 507 - RNA, 31 nt, severe acute respiratory syndrome coronavirus 2
gcauacacuaauucuuucacacgugguguuu

SEQ ID NO: 508 - RNA, 31 nt, severe acute respiratory syndrome coronavirus 2
uauaauaugagaguuauacauuuuggugcug

SEQ ID NO: 509 - RNA, 31 nt, severe acute respiratory syndrome coronavirus 2
uucaauuauuauaagaaaguugaugguguug

SEQ ID NO: 510 - RNA, 31 nt, severe acute respiratory syndrome coronavirus 2
gacuuauuuagaaaugcccguaaugguguuc

SEQ ID NO: 511 - RNA, 31 nt, severe acute respiratory syndrome coronavirus 2
gcuccagcacauauaucuacuauugguguuu

SEQ ID NO: 512 - RNA, 31 nt, severe acute respiratory syndrome coronavirus 2
aacacuguuuacacaaaaguugaugguguug

SEQ ID NO: 513 - RNA, 31 nt, severe acute respiratory syndrome coronavirus 2
uguauaacacguugcaauuuagguggugcug

SEQ ID NO: 514 - RNA, 31 nt, severe acute respiratory syndrome coronavirus 2
aauucacagacuucauuaagauguggugcuu

SEQ ID NO: 515 - RNA, 31 nt, severe acute respiratory syndrome coronavirus 2
cuagugagaaaaauauuuguugaugguguuc

SEQ ID NO: 516 - RNA, 31 nt, severe acute respiratory syndrome coronavirus 2
cuuucuguuuugcuuuccaugcagggugcug

SEQ ID NO: 517 - RNA, 31 nt, severe acute respiratory syndrome coronavirus 2
aaccgcuacuuuagacugacucuugguguuu

SEQ ID NO: 518 - RNA, 31 nt, severe acute respiratory syndrome coronavirus 2
acagcaagaacuguguaugaugauggugcua

SEQ ID NO: 519 - RNA, 31 nt, severe acute respiratory syndrome coronavirus 2
gcuuguuacaaugguucaccaucugguguuu

SEQ ID NO: 520 - RNA, 31 nt, severe acute respiratory syndrome coronavirus 2
cuaaagagacguguagucuuuaaugguguuu

SEQ ID NO: 521 - RNA, 31 nt, severe acute respiratory syndrome coronavirus 2
acaccaguuuacucauucuuaccugguguuu

SEQ ID NO: 522 - RNA, 31 nt, severe acute respiratory syndrome coronavirus 2
uuuacaccacuaauucaaccuauuggugcuu

SEQ ID NO: 523 - RNA, 31 nt, severe acute respiratory syndrome coronavirus 2
ggcacuugugaaagaucagaagcugguguuu

SEQ ID NO: 524 - RNA, 31 nt, severe acute respiratory syndrome coronavirus 2
gaaaacaugacaccccgugaccuuggugcuu

SEQ ID NO: 525 - RNA, 31 nt, severe acute respiratory syndrome coronavirus 2
gucgaauguacaacuauuguuaaugguguua

SEQ ID NO: 526 - RNA, 31 nt, severe acute respiratory syndrome coronavirus 2
aaaccaguuacuuauaaauuggaugguguug

SEQ ID NO: 527 - RNA, 31 nt, severe acute respiratory syndrome coronavirus 2
aaagaaacuuuguauugcauagacggugcuu

SEQ ID NO: 528 - RNA, 31 nt, severe acute respiratory syndrome coronavirus 2
auacaagagggugugguugauuauggugcua

SEQ ID NO: 529 - RNA, 31 nt, severe acute respiratory syndrome coronavirus 2
ccauuauuaucagcugguauuuuuggugcug

SEQ ID NO: 530 - RNA, 31 nt, severe acute respiratory syndrome coronavirus 2
guuguaauggccuacauuacaggugguguug

SEQ ID NO: 531 - RNA, 31 nt, severe acute respiratory syndrome coronavirus 2
aacuggaacacuaaacauagcagugguguua

SEQ ID NO: 532 - RNA, 31 nt, Middle East respiratory syndrome-related coronavirus
auuaauagugugguccaaaaggaugguguug

SEQ ID NO: 533 - RNA, 31 nt, Middle East respiratory syndrome-related coronavirus
cuuaagcauggcggugguaucgcuggugcua

SEQ ID NO: 534 - RNA, 31 nt, Middle East respiratory syndrome-related coronavirus
cagcuuggaugcguuuucuuuaauggugcug

SEQ ID NO: 535 - RNA, 31 nt, Middle East respiratory syndrome-related coronavirus
auggcuuauggcaauugcacauuuggugcuc

SEQ ID NO: 536 - RNA, 31 nt, Middle East respiratory syndrome-related coronavirus
caaaccguucugcaauguguaauuggugcuu

SEQ ID NO: 537 - RNA, 31 nt, Middle East respiratory syndrome-related coronavirus
caaauugucuugcguaauucuaauggugcuu

SEQ ID NO: 538 - RNA, 31 nt, Middle East respiratory syndrome-related coronavirus
uucacugcuaacaaaauuguugguggugcuc

SEQ ID NO: 539 - RNA, 31 nt, Middle East respiratory syndrome-related coronavirus
guugcaguaauugcuggaguugcuggugcuc

SEQ ID NO: 540 - RNA, 31 nt, Middle East respiratory syndrome-related coronavirus
uuuaacaaguauaaguacuucucuggugcua

SEQ ID NO: 541 - RNA, 31 nt, Middle East respiratory syndrome-related coronavirus
cauauagaacauccugaugucucugguguuu

SEQ ID NO: 542 - RNA, 31 nt, Middle East respiratory syndrome-related coronavirus
uuuguugaaaaucccaguguuauugguguuu

SEQ ID NO: 543 - RNA, 31 nt, Middle East respiratory syndrome-related coronavirus
ucgcuuggcaaaugagugugcucaggugcua

SEQ ID NO: 544 - RNA, 31 nt, Middle East respiratory syndrome-related coronavirus
acugcuaaugucagugcacuuaugggugcua

SEQ ID NO: 545 - RNA, 31 nt, Middle East respiratory syndrome-related coronavirus
agcuggauaggcuucgauguugagggugcuc

SEQ ID NO: 546 - RNA, 31 nt, Middle East respiratory syndrome-related coronavirus
gugaacuuuguuguucagccaguugguguug

SEQ ID NO: 547 - RNA, 31 nt, Middle East respiratory syndrome-related coronavirus
ucucugcaucagguuuccgccuuugguguua

SEQ ID NO: 548 - RNA, 31 nt, Middle East respiratory syndrome-related coronavirus
guuguuaaacaaggccauuuuauugguguug

SEQ ID NO: 549 - RNA, 31 nt, Middle East respiratory syndrome-related coronavirus
gguccugauuaugcuuacuucaauggugcua

SEQ ID NO: 550 - RNA, 31 nt, Middle East respiratory syndrome-related coronavirus
acuauuaaagaaaauauagaugguggugcua

SEQ ID NO: 551 - RNA, 31 nt, Middle East respiratory syndrome-related coronavirus
aauugcguggaauauucccucuaugguguuu

SEQ ID NO: 552 - RNA, 31 nt, Middle East respiratory syndrome-related coronavirus
ucccucuaugguguuucgggccgugguguuu

SEQ ID NO: 553 - RNA, 31 nt, Middle East respiratory syndrome-related coronavirus
gcuagcgagcuaucuaauacuuuuggugcua

SEQ ID NO: 554 - RNA, 31 nt, Middle East respiratory syndrome-related coronavirus
cucaaaauggcuggcaugcauuucggugcuu

SEQ ID NO: 555 - RNA, 31 nt, Human coronavirus HKU1
agugaaguuaaagcccaaucaucugguguua

SEQ ID NO: 556 - RNA, 31 nt, Human coronavirus HKU1
aaucuugaacaaaaucauauucuugguguua

SEQ ID NO: 557 - RNA, 31 nt, Human coronavirus HKU1
uugauauuaaugcguaugcuaauugguguug

SEQ ID NO: 558 - RNA, 31 nt, Human coronavirus HKU1
auagauguuuugcuuacuguagaugguguua

SEQ ID NO: 559 - RNA, 31 nt, Human coronavirus HKU1
gguauuaaacaagaaagucguguugguguug

SEQ ID NO: 560 - RNA, 31 nt, Human coronavirus HKU1
gauuuagguguucuuauacagaauggugcua

SEQ ID NO: 561 - RNA, 31 nt, Human coronavirus HKU1
gcuaguuuuaaaguuauugauaaugguguug

SEQ ID NO: 562 - RNA, 31 nt, Human coronavirus HKU1
ccacauccuuauuguuauucagaugguguua

SEQ ID NO: 563 - RNA, 31 nt, Human coronavirus HKU1
cauuugcaauggauuguuauguauggugcua

SEQ ID NO: 564 - RNA, 31 nt, Human coronavirus HKU1
uuauuuucauauuguaggaaaauugguguua

SEQ ID NO: 565 - RNA, 31 nt, Human coronavirus HKU1
ccuuacacuccaaaauauacuuuugguguug

SEQ ID NO: 566 - RNA, 31 nt, Human coronavirus HKU1
ucugacguuuaucaacaauuggcugguguua

SEQ ID NO: 567 - RNA, 31 nt, Human coronavirus HKU1
auguauauuaauacacauaugauugguguua

SEQ ID NO: 568 - RNA, 31 nt, Human coronavirus HKU1
ucuucaacaauuagauugcaggcugguguug

SEQ ID NO: 569 - RNA, 31 nt, Human coronavirus HKU1
uauuaugaguugacuaaaaguugugguguug

SEQ ID NO: 570 - RNA, 31 nt, Human coronavirus HKU1
acuuuaguaaaaguagguuuaguugguguuu

SEQ ID NO: 571 - RNA, 31 nt, Human coronavirus HKU1
cuuguuagacaaauuuuuguagaugguguuc

SEQ ID NO: 572 - RNA, 31 nt, Human coronavirus HKU1
uugaagaguauagcagcuacucgugguguuc

SEQ ID NO: 573 - RNA, 31 nt, Human coronavirus HKU1
aguaugaugauuuugagugaugaugguguug

SEQ ID NO: 574 - RNA, 31 nt, Human coronavirus HKU1
uuuugauaaaaugaauuaacuaaugguguuu

SEQ ID NO: 575 - RNA, 31 nt, Human coronavirus HKU1
ccauugcaaauagguuuuucaacugguguug

SEQ ID NO: 576 - RNA, 31 nt, Human coronavirus HKU1
uguaucacacgauguaauuuagguggugcug

SEQ ID NO: 577 - RNA, 31 nt, Human coronavirus HKU1
guacuuuuugauggucgugacaauggugcuu

SEQ ID NO: 578 - RNA, 31 nt, Human coronavirus HKU1
gaagcuuuuagaaaagcaagaaaugguguuu

SEQ ID NO: 579 - RNA, 31 nt, Human coronavirus HKU1
agaaauaguacaacauggaaugguggugcuu

SEQ ID NO: 580 - RNA, 31 nt, Human coronavirus HKU1
uuuacagguuauuuuccuaaaucuggugcua

SEQ ID NO: 581 - RNA, 31 nt, Human coronavirus HKU1
uauuuucauuuuuaucaagaacgugguguuu

SEQ ID NO: 582 - RNA, 31 nt, Human coronavirus HKU1
acucaaucuuuugcaccuaauacugguguuu

SEQ ID NO: 583 - RNA, 31 nt, Human coronavirus HKU1
uauucuaacacugaaguuucuacugguguuu

SEQ ID NO: 584 - RNA, 31 nt, Human coronavirus HKU1
uuacaacaauuauuuaauaaauuuggugcua

SEQ ID NO: 585 - RNA, 31 nt, Human coronavirus HKU1
gacaccucucauaagaauaauuuugguguua

SEQ ID NO: 586 - RNA, 31 nt, Human coronavirus HKU1
cuugcugaauuagccccuacaccaggugcuu

SEQ ID NO: 587 - RNA, 31 nt, human hepatitis C virus type 1
gauguauggagaaaaguauccagugguguug

SEQ ID NO: 588 - RNA, 31 nt, human hepatitis C virus type 1
gaaggcaaagacagcuauugaaaugguguua

SEQ ID NO: 589 - RNA, 31 nt, human hepatitis C virus type 1
gcaucuugucuggagagacaauuugguguuu

SEQ ID NO: 590 - RNA, 29 nt, Homo sapiens
uguuugaauaugugguaacauaugaagga

SEQ ID NO: 591 - RNA, 25 nt, Homo sapiens
ugugcauguaccggggaaugaaggu

SEQ ID NO: 592 - RNA, 29 nt, Homo sapiens
uucacaggcacuccuggagauaugaagga

SEQ ID NO: 593 - RNA, 29 nt, Homo sapiens
ggggcggguguccguccggaaaugaagga

SEQ ID NO: 594 - RNA, 23 nt, Homo sapiens
ugaauuuucauucaucuucucag

SEQ ID NO: 595 - RNA, 23 nt, Homo sapiens
aaggucugaaauuaucuucucaa

SEQ ID NO: 596 - RNA, 23 nt, Homo sapiens
auguguggaguuacucuucucau

SEQ ID NO: 597 - RNA, 23 nt, Homo sapiens
aagcauggcuugcauuucucaaa

SEQ ID NO: 598 - RNA, 23 nt, Homo sapiens
cagccaagaaaacgucuucucag

SEQ ID NO: 599 - RNA, 23 nt, Homo sapiens
gguaguugacauauuuucucaaa

SEQ ID NO: 600 - RNA, 23 nt, Homo sapiens
cgaguuuuugucuuucuucucag

SEQ ID NO: 601 - RNA, 23 nt, Homo sapiens
gagauacaauccagucuucucau

SEQ ID NO: 602 - RNA, 23 nt, Homo sapiens
ucuuagaauguucaguucucaau

SEQ ID NO: 603 - RNA, 23 nt, Homo sapiens
ucacauacuauuacgcuucucaa

SEQ ID NO: 604 - RNA, 23 nt, Homo sapiens
aagucagcaggaugucuucucac

SEQ ID NO: 605 - RNA, 23 nt, Homo sapiens
ugggaccacuguaaacuucucag

SEQ ID NO: 606 - RNA, 23 nt, Homo sapiens
uguaaaccuacccagcuucucag

SEQ ID NO: 607 - RNA, 23 nt, Homo sapiens
agacacaggcaugugcuucucag

SEQ ID NO: 608 - RNA, 23 nt, Homo sapiens
gaagagagguucguacuucucau

SEQ ID NO: 609 - RNA, 23 nt, Homo sapiens
uucucauauauugaauucucaac

SEQ ID NO: 610 - RNA, 23 nt, Homo sapiens
aaaaaucuuuuuucacuucucau

SEQ ID NO: 611 - RNA, 23 nt, Homo sapiens
cuacucaaaacacaacuucucag

SEQ ID NO: 612 - RNA, 23 nt, Homo sapiens
gaggcaguuggcaaacuucucag

SEQ ID NO: 613 - RNA, 23 nt, Homo sapiens
auggaaagggucuuccuucucau

SEQ ID NO: 614 - RNA, 23 nt, Homo sapiens
uucuuuguauauaggcuucucac

SEQ ID NO: 615 - RNA, 23 nt, Homo sapiens
uguuuuuugucauuguucucaag

SEQ ID NO: 616 - RNA, 23 nt, Homo sapiens
gaguuuccuagugggcuucucaa

SEQ ID NO: 617 - RNA, 23 nt, Homo sapiens
auguuuuauguaacucuucucag

SEQ ID NO: 618 - RNA, 23 nt, Homo sapiens
uggacaguagauggacuucucag

SEQ ID NO: 619 - RNA, 23 nt, Homo sapiens
gucagggaagaaagacuucucaa

SEQ ID NO: 620 - RNA, 23 nt, Artificial Sequence
  Modified miR-29 guide strand
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): 2'-O-methyladenosine
  modified_base (16)..(16): um
  modified_base (17)..(17): cm
  modified_base (18)..(18): 2'-O-methyladenosine
  modified_base (19)..(19): gm
  misc_feature (21)..(22): methylphosphonate linkage
  modified_base (22)..(22): 2'-fluorouridine
  misc_feature (22)..(23): methylphosphonate linkage
  modified_base (23)..(23): um
uagcaccauuugaaaucaguguu

SEQ ID NO: 621 - RNA, 23 nt, Homo sapiens
uuaacaacagugcccuguuuaca

SEQ ID NO: 622 - RNA, 22 nt, Homo sapiens
aggaacauggcaguauguuuac

SEQ ID NO: 623 - RNA, 23 nt, Homo sapiens
aacugucaugguuuaguuuacaa

SEQ ID NO: 624 - RNA, 23 nt, Artificial Sequence
  Modified miR-30 Guide strand
uguaaacauccugacacucagcu

SEQ ID NO: 625 - RNA, 23 nt, Artificial Sequence
  Modified miR-30 Guide strand
uguaaacaucccgugacaggaag

SEQ ID NO: 626 - RNA, 23 nt, Artificial Sequence
  Modified miR-30 Guide strand
uguaaacauccugcgacuaggaa

SEQ ID NO: 627 - RNA, 23 nt, Artificial Sequence
  Modified miR-30 Guide strand
uguaaacauccugcgacugguaa

SEQ ID NO: 628 - RNA, 22 nt, Artificial Sequence
  Modified miR-30 Guide strand
uguaaacaucccugacuggaag

SEQ ID NO: 629 - RNA, 22 nt, Artificial Sequence
  Modified miR-30 Guide strand
uguaaacauccucgacucagcu

SEQ ID NO: 630 - RNA, 23 nt, Artificial Sequence
  Modified miR-30 Guide strand
uguaaacauccucgacucucagc

SEQ ID NO: 631 - RNA, 22 nt, Artificial Sequence
  Modified miR-30 Guide strand
uguaaacauccuucacucagcu

SEQ ID NO: 632 - RNA, 23 nt, Artificial Sequence
  Modified miR-30 Guide strand
uguaaacauccuucacucucagc

SEQ ID NO: 633 - RNA, 22 nt, Artificial Sequence
  Modified miR-30 Guide strand
uguaaacaucccacacucagcu

SEQ ID NO: 634 - RNA, 23 nt, Artificial Sequence
  Modified miR-30 Guide strand
uguaaacaucccacacucucagc

SEQ ID NO: 635 - RNA, 22 nt, Artificial Sequence
  Modified miR-30 Guide strand
uguaaacaucccucacucagcu

SEQ ID NO: 636 - RNA, 23 nt, Artificial Sequence
  Modified miR-30 Guide strand
uguaaacaucccucacucucagc

SEQ ID NO: 637 - RNA, 23 nt, Artificial Sequence
  Modified miR-30 Guide strand
uguaaacauccugcgacucagcu

SEQ ID NO: 638 - RNA, 22 nt, Artificial Sequence
  Modified miR-30 Guide strand
uguaaacauccucgacaggaag

SEQ ID NO: 639 - RNA, 23 nt, Artificial Sequence
  Modified miR-30 Guide strand
uguaaacauccugcgacaggaag

SEQ ID NO: 640 - RNA, 23 nt, Artificial Sequence
  Modified miR-30 Guide strand
uguaaacauccucgacauggaag

SEQ ID NO: 641 - RNA, 23 nt, Artificial Sequence
  Modified miR-30 Guide strand
uguaaacauccucgaacuggaag

SEQ ID NO: 642 - RNA, 23 nt, Artificial Sequence
  Modified miR-30 Guide strand
uguaaacauccugcgaacuggaa

SEQ ID NO: 643 - RNA, 22 nt, Artificial Sequence
  Modified miR-30 Guide strand
uguaaacaucccugacaggaag

SEQ ID NO: 644 - RNA, 23 nt, Artificial Sequence
  Modified miR-30 Guide strand
  modified_base (11)..(11): cm
  modified_base (12)..(12): um
  modified_base (13)..(13): gm
  misc_feature (13)..(14): phosphorothioate linkage
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (21)..(22): phosphorothioate linkage
  modified_base (22)..(22): 2'-fluoroadenosine
  misc_feature (22)..(23): phosphorothioate linkage
  modified_base (23)..(23): 2'-O-methyladenosine
uguaaacauccugcgacuggaaa

SEQ ID NO: 645 - RNA, 22 nt, Artificial Sequence
  Modified miR-30 Guide strand
  modified_base (11)..(11): cm
  modified_base (12)..(12): um
  misc_feature (12)..(13): phosphorothioate linkage
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  misc_feature (20)..(21): phosphorothioate linkage
  modified_base (21)..(21): 2'-fluoroadenosine
  misc_feature (21)..(22): phosphorothioate linkage
  modified_base (22)..(22): 2'-O-methyladenosine
uguaaacauccugcgacuggaa

SEQ ID NO: 646 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): gm
  modified_base (22)..(22): 2'-fluoroadenosine
  modified_base (24)..(24): gm
uguaaacaucccugacaggaag

SEQ ID NO: 647 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): 2'-O-methyladenosine
  modified_base (22)..(22): 2'-fluoroadenosine
  modified_base (24)..(24): gm
uguaaacaucccugacaggaag

SEQ ID NO: 648 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacaucccugacaggaag

SEQ ID NO: 649 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): gm
  modified_base (22)..(22): 2'-fluoroadenosine
  modified_base (24)..(24): gm
uguaaacaucccugacaggaag

SEQ ID NO: 650 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): 2'-O-methyladenosine
  modified_base (22)..(22): 2'-fluoroadenosine
  modified_base (24)..(24): gm
uguaaacaucccugacaggaag

SEQ ID NO: 651 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacaucccugacaggaag

SEQ ID NO: 652 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): gm
  modified_base (22)..(22): 2'-fluoroadenosine
  modified_base (24)..(24): gm
uguaaacaucccugacaggaag

SEQ ID NO: 653 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): 2'-O-methyladenosine
  modified_base (22)..(22): 2'-fluoroadenosine
  modified_base (24)..(24): gm
uguaaacaucccugacaggaag

SEQ ID NO: 654 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacaucccugacaggaag

SEQ ID NO: 655 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (18)..(18): cm
  modified_base (19)..(19): um
  modified_base (23)..(23): 2'-fluoroadenosine
  modified_base (25)..(25): 2'-O-methyladenosine
uguaaacauccugcgaacuggaa

SEQ ID NO: 656 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (18)..(18): cm
  modified_base (23)..(23): 2'-fluoroadenosine
  modified_base (25)..(25): 2'-O-methyladenosine
uguaaacauccugcgaacuggaa

SEQ ID NO: 657 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (23)..(23): 2'-fluoroadenosine
  modified_base (25)..(25): 2'-O-methyladenosine
uguaaacauccugcgaacuggaa

SEQ ID NO: 658 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (18)..(18): cm
  modified_base (19)..(19): um
  modified_base (23)..(23): 2'-fluoroadenosine
  modified_base (25)..(25): 2'-O-methyladenosine
uguaaacauccugcgaacuggaa

SEQ ID NO: 659 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (18)..(18): cm
  modified_base (23)..(23): 2'-fluoroadenosine
  modified_base (25)..(25): 2'-O-methyladenosine
uguaaacauccugcgaacuggaa

SEQ ID NO: 660 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (23)..(23): 2'-fluoroadenosine
  modified_base (25)..(25): 2'-O-methyladenosine
uguaaacauccugcgaacuggaa

SEQ ID NO: 661 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (18)..(18): cm
  modified_base (19)..(19): um
  modified_base (23)..(23): 2'-fluoroadenosine
  modified_base (25)..(25): 2'-O-methyladenosine
uguaaacauccugcgaacuggaa

SEQ ID NO: 662 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (18)..(18): cm
  modified_base (23)..(23): 2'-fluoroadenosine
  modified_base (25)..(25): 2'-O-methyladenosine
uguaaacauccugcgaacuggaa

SEQ ID NO: 663 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): 2'-O-methyladenosine
  modified_base (23)..(23): 2'-fluoroadenosine
  modified_base (25)..(25): 2'-O-methyladenosine
uguaaacauccugcgaacuggaa

SEQ ID NO: 664 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (18)..(18): um
  modified_base (19)..(19): gm
  modified_base (23)..(23): 2'-fluoroadenosine
  modified_base (25)..(25): gm
uguaaacauccucgaacuggaag

SEQ ID NO: 665 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): gm
uguaaacauccucgaacuggaag

SEQ ID NO: 666 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (23)..(23): 2'-fluoroadenosine
  modified_base (25)..(25): gm
uguaaacauccucgaacuggaag

SEQ ID NO: 667 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (18)..(18): um
  modified_base (19)..(19): gm
  modified_base (23)..(23): 2'-fluoroadenosine
  modified_base (25)..(25): gm
uguaaacauccucgaacuggaag

SEQ ID NO: 668 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): gm
uguaaacauccucgaacuggaag

SEQ ID NO: 669 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (23)..(23): 2'-fluoroadenosine
  modified_base (25)..(25): gm
uguaaacauccucgaacuggaag

SEQ ID NO: 670 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (18)..(18): um
  modified_base (19)..(19): gm
  modified_base (23)..(23): 2'-fluoroadenosine
  modified_base (25)..(25): gm
uguaaacauccucgaacuggaag

SEQ ID NO: 671 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): gm
uguaaacauccucgaacuggaag

SEQ ID NO: 672 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): 2'-O-methyladenosine
  modified_base (17)..(17): cm
  modified_base (23)..(23): 2'-fluoroadenosine
  modified_base (25)..(25): gm
uguaaacauccucgaacuggaag

SEQ ID NO: 673 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): um
  modified_base (19)..(19): gm
  modified_base (23)..(23): 2'-fluoroadenosine
  modified_base (25)..(25): gm
uguaaacauccucgacauggaag

SEQ ID NO: 674 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): um
  modified_base (23)..(23): 2'-fluoroadenosine
  modified_base (25)..(25): gm
uguaaacauccucgacauggaag

SEQ ID NO: 675 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (23)..(23): 2'-fluoroadenosine
  modified_base (25)..(25): gm
uguaaacauccucgacauggaag

SEQ ID NO: 676 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): um
  modified_base (19)..(19): gm
  modified_base (23)..(23): 2'-fluoroadenosine
  modified_base (25)..(25): gm
uguaaacauccucgacauggaag

SEQ ID NO: 677 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): um
  modified_base (23)..(23): 2'-fluoroadenosine
  modified_base (25)..(25): gm
uguaaacauccucgacauggaag

SEQ ID NO: 678 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (23)..(23): 2'-fluoroadenosine
  modified_base (25)..(25): gm
uguaaacauccucgacauggaag

SEQ ID NO: 679 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): um
  modified_base (19)..(19): gm
  modified_base (23)..(23): 2'-fluoroadenosine
  modified_base (25)..(25): gm
uguaaacauccucgacauggaag

SEQ ID NO: 680 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): um
  modified_base (23)..(23): 2'-fluoroadenosine
  modified_base (25)..(25): gm
uguaaacauccucgacauggaag

SEQ ID NO: 681 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (23)..(23): 2'-fluoroadenosine
  modified_base (25)..(25): gm
uguaaacauccucgacauggaag

SEQ ID NO: 682 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): 2'-O-methyladenosine
  modified_base (19)..(19): gm
  modified_base (23)..(23): 2'-fluoroadenosine
  modified_base (25)..(25): gm
uguaaacauccugcgacaggaag

SEQ ID NO: 683 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): 2'-O-methyladenosine
  modified_base (23)..(23): 2'-fluoroadenosine
  modified_base (25)..(25): gm
uguaaacauccugcgacaggaag

SEQ ID NO: 684 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): gm
uguaaacauccugcgacaggaag

SEQ ID NO: 685 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): 2'-O-methyladenosine
  modified_base (19)..(19): gm
  modified_base (23)..(23): 2'-fluoroadenosine
  modified_base (25)..(25): gm
uguaaacauccugcgacaggaag

SEQ ID NO: 686 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): 2'-O-methyladenosine
  modified_base (23)..(23): 2'-fluoroadenosine
  modified_base (25)..(25): gm
uguaaacauccugcgacaggaag

SEQ ID NO: 687 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): gm
uguaaacauccugcgacaggaag

SEQ ID NO: 688 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): 2'-O-methyladenosine
  modified_base (19)..(19): gm
  modified_base (23)..(23): 2'-fluoroadenosine
  modified_base (25)..(25): gm
uguaaacauccugcgacaggaag

SEQ ID NO: 689 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): 2'-O-methyladenosine
  modified_base (23)..(23): 2'-fluoroadenosine
  modified_base (25)..(25): gm
uguaaacauccugcgacaggaag

SEQ ID NO: 690 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): gm
uguaaacauccugcgacaggaag

SEQ ID NO: 691 - RNA, 22 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): gm
  modified_base (22)..(22): 2'-fluoroadenosine
  modified_base (24)..(24): gm
uguaaacauccucgacaggaag

SEQ ID NO: 692 - RNA, 22 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (22)..(22): 2'-fluoroadenosine
  modified_base (24)..(24): gm
uguaaacauccucgacaggaag

SEQ ID NO: 693 - RNA, 22 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacauccucgacaggaag

SEQ ID NO: 694 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): gm
  modified_base (22)..(22): 2'-fluoroadenosine
  modified_base (24)..(24): gm
uguaaacauccucgacaggaag

SEQ ID NO: 695 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (22)..(22): 2'-fluoroadenosine
  modified_base (24)..(24): gm
uguaaacauccucgacaggaag

SEQ ID NO: 696 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacauccucgacaggaag

SEQ ID NO: 697 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (18)..(18): gm
  modified_base (22)..(22): 2'-fluoroadenosine
  modified_base (24)..(24): gm
uguaaacauccucgacaggaag

SEQ ID NO: 698 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): 2'-O-methyladenosine
  modified_base (22)..(22): 2'-fluoroadenosine
  modified_base (24)..(24): gm
uguaaacauccucgacaggaag

SEQ ID NO: 699 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacauccucgacaggaag

SEQ ID NO: 700 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): cm
  modified_base (23)..(23): 2'-fluorocytidine
  modified_base (25)..(25): um
uguaaacauccugcgacucagcu

SEQ ID NO: 701 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluorocytidine
  modified_base (25)..(25): um
uguaaacauccugcgacucagcu

SEQ ID NO: 702 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluorocytidine
  modified_base (25)..(25): um
uguaaacauccugcgacucagcu

SEQ ID NO: 703 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): cm
  modified_base (23)..(23): 2'-fluorocytidine
  modified_base (25)..(25): um
uguaaacauccugcgacucagcu

SEQ ID NO: 704 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluorocytidine
  modified_base (25)..(25): um
uguaaacauccugcgacucagcu

SEQ ID NO: 705 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluorocytidine
  modified_base (25)..(25): um
uguaaacauccugcgacucagcu

SEQ ID NO: 706 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): cm
  modified_base (23)..(23): 2'-fluorocytidine
  modified_base (25)..(25): um
uguaaacauccugcgacucagcu

SEQ ID NO: 707 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluorocytidine
  modified_base (25)..(25): um
uguaaacauccugcgacucagcu

SEQ ID NO: 708 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluorocytidine
  modified_base (25)..(25): um
uguaaacauccugcgacucagcu

SEQ ID NO: 709 - RNA, 23 nt, Artificial Sequence
  Modified miR-30 Guide strand
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacaucccucacucucagc

SEQ ID NO: 710 - RNA, 23 nt, Artificial Sequence
  Modified miR-30 Guide strand
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacaucccucacucucagc

SEQ ID NO: 711 - RNA, 23 nt, Artificial Sequence
  Modified miR-30 Guide strand
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacaucccucacucucagc

SEQ ID NO: 712 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacaucccucacucucagc

SEQ ID NO: 713 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacaucccucacucucagc

SEQ ID NO: 714 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacaucccucacucucagc

SEQ ID NO: 715 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacaucccucacucucagc

SEQ ID NO: 716 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacaucccucacucucagc

SEQ ID NO: 717 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacaucccucacucucagc

SEQ ID NO: 718 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacaucccucacucagcu

SEQ ID NO: 719 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacaucccucacucagcu

SEQ ID NO: 720 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacaucccucacucagcu

SEQ ID NO: 721 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacaucccucacucagcu

SEQ ID NO: 722 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacaucccucacucagcu

SEQ ID NO: 723 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacaucccucacucagcu

SEQ ID NO: 724 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacaucccucacucagcu

SEQ ID NO: 725 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacaucccucacucagcu

SEQ ID NO: 726 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacaucccucacucagcu

SEQ ID NO: 727 - RNA, 23 nt, Artificial Sequence
  Modified miR-30 Guide strand
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacaucccacacucucagc

SEQ ID NO: 728 - RNA, 23 nt, Artificial Sequence
  Modified miR-30 Guide strand
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacaucccacacucucagc

SEQ ID NO: 729 - RNA, 23 nt, Artificial Sequence
  Modified miR-30 Guide strand
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacaucccacacucucagc

SEQ ID NO: 730 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacaucccacacucucagc

SEQ ID NO: 731 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacaucccacacucucagc

SEQ ID NO: 732 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacaucccacacucucagc

SEQ ID NO: 733 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacaucccacacucucagc

SEQ ID NO: 734 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacaucccacacucucagc

SEQ ID NO: 735 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacaucccacacucucagc

SEQ ID NO: 736 - RNA, 22 nt, Artificial Sequence
  Modified miR-30 Guide strand
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacaucccacacucagcu

SEQ ID NO: 737 - RNA, 22 nt, Artificial Sequence
  Modified miR-30 Guide strand
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacaucccacacucagcu

SEQ ID NO: 738 - RNA, 22 nt, Artificial Sequence
  Modified miR-30 Guide strand
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacaucccacacucagcu

SEQ ID NO: 739 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacaucccacacucagcu

SEQ ID NO: 740 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacaucccacacucagcu

SEQ ID NO: 741 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacaucccacacucagcu

SEQ ID NO: 742 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacaucccacacucagcu

SEQ ID NO: 743 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacaucccacacucagcu

SEQ ID NO: 744 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): 2'-O-methyladenosine
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacaucccacacucagcu

SEQ ID NO: 745 - RNA, 23 nt, Artificial Sequence
  Modified miR-30 Guide strand
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacauccuucacucucagc

SEQ ID NO: 746 - RNA, 23 nt, Artificial Sequence
  Modified miR-30 Guide strand
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacauccuucacucucagc

SEQ ID NO: 747 - RNA, 23 nt, Artificial Sequence
  Modified miR-30 Guide strand
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacauccuucacucucagc

SEQ ID NO: 748 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacauccuucacucucagc

SEQ ID NO: 749 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacauccuucacucucagc

SEQ ID NO: 750 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacauccuucacucucagc

SEQ ID NO: 751 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacauccuucacucucagc

SEQ ID NO: 752 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacauccuucacucucagc

SEQ ID NO: 753 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacauccuucacucucagc

SEQ ID NO: 754 - RNA, 22 nt, Artificial Sequence
  Modified miR-30 Guide strand
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacauccuucacucagcu

SEQ ID NO: 755 - RNA, 22 nt, Artificial Sequence
  Modified miR-30 Guide strand
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacauccuucacucagcu

SEQ ID NO: 756 - RNA, 22 nt, Artificial Sequence
  Modified miR-30 Guide strand
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacauccuucacucagcu

SEQ ID NO: 757 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacauccuucacucagcu

SEQ ID NO: 758 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacauccuucacucagcu

SEQ ID NO: 759 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacauccuucacucagcu

SEQ ID NO: 760 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacauccuucacucagcu

SEQ ID NO: 761 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacauccuucacucagcu

SEQ ID NO: 762 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): um
  modified_base (14)..(14): cm
  modified_base (15)..(15): 2'-O-methyladenosine
  modified_base (16)..(16): cm
  modified_base (22)..(22): 2'-fluorocytidine
  modified_base (24)..(24): um
uguaaacauccuucacucagcu

SEQ ID NO: 763 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacauccucgacucucagc

SEQ ID NO: 764 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacauccucgacucucagc

SEQ ID NO: 765 - RNA, 23 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacauccucgacucucagc

SEQ ID NO: 766 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacauccucgacucucagc

SEQ ID NO: 767 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacauccucgacucucagc

SEQ ID NO: 768 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacauccucgacucucagc

SEQ ID NO: 769 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (19)..(19): um
  modified_base (23)..(23): 2'-fluoroguanosine
  modified_base (25)..(25): cm
uguaaacauccucgacucucagc

SEQ ID NO: 770 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (23)..(23): 2'-fluoroguanosine
  modified_base (25)..(25): cm
uguaaacauccucgacucucagc

SEQ ID NO: 771 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (23)..(23): 2'-fluoroguanosine
  modified_base (25)..(25): cm
uguaaacauccucgacucucagc

SEQ ID NO: 772 - RNA, 22 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacauccucgacucagcu

SEQ ID NO: 773 - RNA, 22 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacauccucgacucagcu

SEQ ID NO: 774 - RNA, 22 nt, Artificial Sequence
  Modified miR-30 Guide strand
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (22)..(22): 2'-fluorocytidine
  modified_base (24)..(24): um
uguaaacauccucgacucagcu

SEQ ID NO: 775 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacauccucgacucagcu

SEQ ID NO: 776 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacauccucgacucagcu

SEQ ID NO: 777 - RNA, 22 nt, Artificial Sequence
  Modified miR-30 Guide strand
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (22)..(22): 2'-fluorocytidine
  modified_base (24)..(24): um
uguaaacauccucgacucagcu

SEQ ID NO: 778 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (18)..(18): cm
  modified_base (22)..(22): 2'-fluorocytidine
  modified_base (24)..(24): um
uguaaacauccucgacucagcu

SEQ ID NO: 779 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (17)..(17): um
  modified_base (22)..(22): 2'-fluorocytidine
  modified_base (24)..(24): um
uguaaacauccucgacucagcu

SEQ ID NO: 780 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): cm
  modified_base (14)..(14): gm
  modified_base (15)..(15): 2'-O-methyladenosine
  modified_base (16)..(16): cm
  modified_base (22)..(22): 2'-fluorocytidine
  modified_base (24)..(24): um
uguaaacauccucgacucagcu

SEQ ID NO: 781 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): um
  modified_base (18)..(18): gm
  modified_base (22)..(22): 2'-fluoroadenosine
  modified_base (24)..(24): gm
uguaaacaucccugacuggaag

SEQ ID NO: 782 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): um
  modified_base (22)..(22): 2'-fluoroadenosine
  modified_base (24)..(24): gm
uguaaacaucccugacuggaag

SEQ ID NO: 783 - RNA, 22 nt, Artificial Sequence
  Modified miR-30 Guide strand
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacaucccugacuggaag

SEQ ID NO: 784 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): um
  modified_base (18)..(18): gm
  modified_base (22)..(22): 2'-fluoroadenosine
  modified_base (24)..(24): gm
uguaaacaucccugacuggaag

SEQ ID NO: 785 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): um
  modified_base (22)..(22): 2'-fluoroadenosine
  modified_base (24)..(24): gm
uguaaacaucccugacuggaag

SEQ ID NO: 786 - RNA, 22 nt, Artificial Sequence
  Modified miR-30 Guide strand
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacaucccugacuggaag

SEQ ID NO: 787 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): um
  modified_base (18)..(18): gm
  modified_base (22)..(22): 2'-fluoroadenosine
  modified_base (24)..(24): gm
uguaaacaucccugacuggaag

SEQ ID NO: 788 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (17)..(17): um
  modified_base (22)..(22): 2'-fluoroadenosine
  modified_base (24)..(24): gm
uguaaacaucccugacuggaag

SEQ ID NO: 789 - RNA, 22 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): um
  modified_base (14)..(14): gm
  modified_base (15)..(15): 2'-O-methyladenosine
  modified_base (16)..(16): cm
  modified_base (22)..(22): 2'-fluoroadenosine
  modified_base (24)..(24): gm
uguaaacaucccugacuggaag

SEQ ID NO: 790 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  modified_base (23)..(23): 2'-fluoroadenosine
  modified_base (25)..(25): 2'-O-methyladenosine
uguaaacauccugcgacugguaa

SEQ ID NO: 791 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): 2'-O-methyladenosine
uguaaacauccugcgacugguaa

SEQ ID NO: 792 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): 2'-O-methyladenosine
uguaaacauccugcgacugguaa

SEQ ID NO: 793 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  modified_base (23)..(23): 2'-fluoroadenosine
  modified_base (25)..(25): 2'-O-methyladenosine
uguaaacauccugcgacugguaa

SEQ ID NO: 794 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): 2'-O-methyladenosine
uguaaacauccugcgacugguaa

SEQ ID NO: 795 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): 2'-O-methyladenosine
uguaaacauccugcgacugguaa

SEQ ID NO: 796 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): gm
  modified_base (23)..(23): 2'-fluoroadenosine
  modified_base (25)..(25): 2'-O-methyladenosine
uguaaacauccugcgacugguaa

SEQ ID NO: 797 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): 2'-O-methyladenosine
uguaaacauccugcgacugguaa

SEQ ID NO: 798 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): 2'-O-methyladenosine
uguaaacauccugcgacugguaa

SEQ ID NO: 799 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): 2'-O-methyladenosine
  modified_base (23)..(23): 2'-fluoroadenosine
  modified_base (25)..(25): 2'-O-methyladenosine
uguaaacauccugcgacuaggaa

SEQ ID NO: 800 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): 2'-O-methyladenosine
uguaaacauccugcgacuaggaa

SEQ ID NO: 801 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): 2'-O-methyladenosine
uguaaacauccugcgacuaggaa

SEQ ID NO: 802 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): 2'-O-methyladenosine
  modified_base (23)..(23): 2'-fluoroadenosine
  modified_base (25)..(25): 2'-O-methyladenosine
uguaaacauccugcgacuaggaa

SEQ ID NO: 803 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): 2'-O-methyladenosine
uguaaacauccugcgacuaggaa

SEQ ID NO: 804 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): 2'-O-methyladenosine
uguaaacauccugcgacuaggaa

SEQ ID NO: 805 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (19)..(19): 2'-O-methyladenosine
  modified_base (23)..(23): 2'-fluoroadenosine
  modified_base (25)..(25): 2'-O-methyladenosine
uguaaacauccugcgacuaggaa

SEQ ID NO: 806 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (18)..(18): um
  modified_base (23)..(23): 2'-fluoroadenosine
  modified_base (25)..(25): 2'-O-methyladenosine
uguaaacauccugcgacuaggaa

SEQ ID NO: 807 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): cm
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): 2'-O-methyladenosine
uguaaacauccugcgacuaggaa

SEQ ID NO: 808 - RNA, 23 nt, Artificial Sequence
  Modified miR-30 Guide strand
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (18)..(18): 2'-O-methyladenosine
  modified_base (19)..(19): gm
  modified_base (23)..(23): 2'-fluoroadenosine
  modified_base (25)..(25): gm
uguaaacaucccgugacaggaag

SEQ ID NO: 809 - RNA, 23 nt, Artificial Sequence
  Modified miR-30 Guide strand
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (18)..(18): 2'-O-methyladenosine
  modified_base (23)..(23): 2'-fluoroadenosine
  modified_base (25)..(25): gm
uguaaacaucccgugacaggaag

SEQ ID NO: 810 - RNA, 23 nt, Artificial Sequence
  Modified miR-30 Guide strand
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): gm
uguaaacaucccgugacaggaag

SEQ ID NO: 811 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (18)..(18): 2'-O-methyladenosine
  modified_base (19)..(19): gm
  modified_base (23)..(23): 2'-fluoroadenosine
  modified_base (25)..(25): gm
uguaaacaucccgugacaggaag

SEQ ID NO: 812 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (18)..(18): 2'-O-methyladenosine
  modified_base (23)..(23): 2'-fluoroadenosine
  modified_base (25)..(25): gm
uguaaacaucccgugacaggaag

SEQ ID NO: 813 - RNA, 23 nt, Artificial Sequence
  Modified miR-30 Guide strand
  modified_base (10)..(10): cm
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): gm
uguaaacaucccgugacaggaag

SEQ ID NO: 814 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (18)..(18): 2'-O-methyladenosine
  modified_base (19)..(19): gm
  modified_base (23)..(23): 2'-fluoroadenosine
  modified_base (25)..(25): gm
uguaaacaucccgugacaggaag

SEQ ID NO: 815 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (18)..(18): 2'-O-methyladenosine
  modified_base (23)..(23): 2'-fluoroadenosine
  modified_base (25)..(25): gm
uguaaacaucccgugacaggaag

SEQ ID NO: 816 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): cm
  modified_base (13)..(13): gm
  modified_base (14)..(14): um
  modified_base (15)..(15): gm
  modified_base (16)..(16): 2'-O-methyladenosine
  modified_base (17)..(17): cm
  modified_base (23)..(23): 2'-fluoroadenosine
  modified_base (25)..(25): gm
uguaaacaucccgugacaggaag

SEQ ID NO: 817 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (18)..(18): um
  modified_base (19)..(19): cm
  modified_base (23)..(23): 2'-fluorocytidine
  modified_base (25)..(25): um
uguaaacauccugacacucagcu

SEQ ID NO: 818 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (18)..(18): um
  modified_base (23)..(23): 2'-fluorocytidine
  modified_base (25)..(25): um
uguaaacauccugacacucagcu

SEQ ID NO: 819 - RNA, 23 nt, Artificial Sequence
  Modified miR-30 Guide strand
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (23)..(23): 2'-fluorocytidine
  modified_base (25)..(25): um
uguaaacauccugacacucagcu

SEQ ID NO: 820 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (18)..(18): um
  modified_base (19)..(19): cm
  modified_base (23)..(23): 2'-fluorocytidine
  modified_base (25)..(25): um
uguaaacauccugacacucagcu

SEQ ID NO: 821 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (18)..(18): um
  modified_base (23)..(23): 2'-fluorocytidine
  modified_base (25)..(25): um
uguaaacauccugacacucagcu

SEQ ID NO: 822 - RNA, 23 nt, Artificial Sequence
  Modified miR-30 Guide strand
  modified_base (10)..(10): cm
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (23)..(23): 2'-fluorocytidine
  modified_base (25)..(25): um
uguaaacauccugacacucagcu

SEQ ID NO: 823 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (18)..(18): um
  modified_base (19)..(19): cm
  modified_base (23)..(23): 2'-fluorocytidine
  modified_base (25)..(25): um
uguaaacauccugacacucagcu

SEQ ID NO: 824 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (18)..(18): um
  modified_base (23)..(23): 2'-fluorocytidine
  modified_base (25)..(25): um
uguaaacauccugacacucagcu

SEQ ID NO: 825 - RNA, 23 nt, Artificial Sequence
  Modified miR-30 Guide strand
  modified_base (9)..(9): um
  modified_base (10)..(10): cm
  modified_base (11)..(11): cm
  modified_base (12)..(12): um
  modified_base (13)..(13): gm
  modified_base (14)..(14): 2'-O-methyladenosine
  modified_base (15)..(15): cm
  modified_base (16)..(16): 2'-O-methyladenosine
  modified_base (17)..(17): cm
  modified_base (23)..(23): 2'-fluorocytidine
  modified_base (25)..(25): um
uguaaacauccugacacucagcu

SEQ ID NO: 826 - RNA, 21 nt, severe acute respiratory syndrome coronavirus
auuuuagaagaugaguuuaca

SEQ ID NO: 827 - RNA, 21 nt, severe acute respiratory syndrome coronavirus
auuuagguggugcuguuugca

SEQ ID NO: 828 - RNA, 19 nt, severe acute respiratory syndrome coronavirus
cuuccuucaggcuguuugc

SEQ ID NO: 829 - RNA, 16 nt, severe acute respiratory syndrome coronavirus 2
accaucugguguuuac

SEQ ID NO: 830 - RNA, 19 nt, severe acute respiratory syndrome coronavirus 2
gucaguuaggugguuuaca

SEQ ID NO: 831 - RNA, 22 nt, severe acute respiratory syndrome coronavirus 2
uuugugcuugcugcuguuuaca

SEQ ID NO: 832 - RNA, 32 nt, Homo sapiens
uuuuuuuuuuuuuuuuaggacaccuguuuacu

SEQ ID NO: 833 - RNA, 32 nt, Homo sapiens
aaaguguuauauuuuuuauaaaaauguuuauu

SEQ ID NO: 834 - RNA, 32 nt, Homo sapiens
ugguacgaugcauccauuucaguuuguuuacg

SEQ ID NO: 835 - RNA, 23 nt, Artificial Sequence
  Modified miR-29 Guide strand
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): 2'-O-methyladenosine
  modified_base (16)..(16): um
  modified_base (17)..(17): cm
  modified_base (18)..(18): 2'-O-methyladenosine
  modified_base (19)..(19): gm
  misc_feature (21)..(22): methylphosphonate linkage
  modified_base (22)..(22): 2'-fluorouridine
  misc_feature (22)..(23): methylphosphonate linkage
  modified_base (23)..(23): um
uagcaccaucugaaaucaguguu

SEQ ID NO: 836 - RNA, 23 nt, Artificial Sequence
  Modified miR-29 Guide strand
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): um
  modified_base (18)..(18): cm
  modified_base (19)..(19): 2'-O-methyladenosine
  misc_feature (21)..(22): methylphosphonate linkage
  modified_base (22)..(22): 2'-fluoroguanosine
  misc_feature (22)..(23): methylphosphonate linkage
  modified_base (23)..(23): um
uagcaccaucugaaggucagugu

SEQ ID NO: 837 - RNA, 23 nt, Artificial Sequence
  Modified miR-29 Guide strand
  modified_base (11)..(11): um
  modified_base (12)..(12): gm
  modified_base (13)..(13): 2'-O-methyladenosine
  modified_base (14)..(14): 2'-O-methyladenosine
  modified_base (15)..(15): gm
  modified_base (16)..(16): gm
  modified_base (17)..(17): cm
  modified_base (18)..(18): 2'-O-methyladenosine
  modified_base (19)..(19): gm
  misc_feature (21)..(22): methylphosphonate linkage
  modified_base (22)..(22): 2'-fluoroguanosine
  misc_feature (22)..(23): methylphosphonate linkage
  modified_base (23)..(23): um
uagcaccaucugaaggcaguggu

SEQ ID NO: 838 - RNA, 21 nt, Artificial Sequence
  Modified miR-29 Passenger strand
  misc_feature (1)..(1): amino C6 linker
  modified_base (1)..(1): cm
  modified_base (2)..(2): 2'-O-methyladenosine
  modified_base (3)..(3): cm
  modified_base (5)..(5): gm
  modified_base (15)..(15): gm
  modified_base (17)..(17): um
  modified_base (19)..(19): um
  modified_base (20)..(20): um
  modified_base (21)..(21): 2'-O-methyladenosine
cacugauuucagaugguguua

SEQ ID NO: 839 - RNA, 21 nt, Artificial Sequence
  Modified miR-29 Passenger strand
  misc_feature (1)..(1): amino C6 linker
  modified_base (1)..(1): cm
  modified_base (2)..(2): 2'-O-methyladenosine
  modified_base (3)..(3): cm
  modified_base (5)..(5): gm
  modified_base (6)..(6): cm
  modified_base (19)..(19): um
  modified_base (20)..(20): um
  modified_base (21)..(21): 2'-O-methyladenosine
cacugcuuucagaugguguua

SEQ ID NO: 840 - RNA, 22 nt, Artificial Sequence
  Modified miR-205 Guide strand
uccuucauaccaccggagucug

SEQ ID NO: 841 - RNA, 22 nt, Artificial Sequence
  Modified miR-205 Guide strand
uccuucaucccaccggagucug

SEQ ID NO: 842 - RNA, 23 nt, Artificial Sequence
  Modified miR-205 Guide strand
uccuucauauccaccggagucug

SEQ ID NO: 843 - RNA, 23 nt, Artificial Sequence
  Modified miR-205 Guide strand
uccuucaucuccaccggagucug

SEQ ID NO: 844 - RNA, 23 nt, Artificial Sequence
  Modified miR-205 Guide strand
uccuucaucaccaccggagucug

SEQ ID NO: 845 - RNA, 23 nt, Artificial Sequence
  Modified miR-205 Guide strand
uccuucauauccuccggagucug

SEQ ID NO: 846 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (22)..(22): 2'-fluorouridine
  modified_base (24)..(24): gm
uccuucauaccaccggagucug

SEQ ID NO: 847 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (22)..(22): 2'-fluorouridine
  modified_base (24)..(24): gm
uccuucauaccaccggagucug

SEQ ID NO: 848 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (22)..(22): 2'-fluorouridine
  modified_base (24)..(24): gm
uccuucauaccaccggagucug

SEQ ID NO: 849 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (22)..(22): 2'-fluorouridine
  modified_base (24)..(24): gm
uccuucauaccaccggagucug

SEQ ID NO: 850 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (22)..(22): 2'-fluorouridine
  modified_base (24)..(24): gm
uccuucauaccaccggagucug

SEQ ID NO: 851 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (22)..(22): 2'-fluorouridine
  modified_base (24)..(24): gm
uccuucauaccaccggagucug

SEQ ID NO: 852 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (22)..(22): 2'-fluorouridine
  modified_base (24)..(24): gm
uccuucauaccaccggagucug

SEQ ID NO: 853 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (22)..(22): 2'-fluorouridine
  modified_base (24)..(24): gm
uccuucauaccaccggagucug

SEQ ID NO: 854 - RNA, 22 nt, Artificial Sequence
  Modified miR-205 Guide strand
  modified_base (9)..(9): 2'-O-methyladenosine
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (22)..(22): 2'-fluorouridine
  modified_base (24)..(24): gm
uccuucauaccaccggagucug

SEQ ID NO: 855 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (22)..(22): 2'-fluorouridine
  modified_base (24)..(24): gm
uccuucaucccaccggagucug

SEQ ID NO: 856 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (22)..(22): 2'-fluorouridine
  modified_base (24)..(24): gm
uccuucaucccaccggagucug

SEQ ID NO: 857 - RNA, 22 nt, Artificial Sequence
  Modified miR-205 Guide strand
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (22)..(22): 2'-fluorouridine
  modified_base (24)..(24): gm
uccuucaucccaccggagucug

SEQ ID NO: 858 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (22)..(22): 2'-fluorouridine
  modified_base (24)..(24): gm
uccuucaucccaccggagucug

SEQ ID NO: 859 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (22)..(22): 2'-fluorouridine
  modified_base (24)..(24): gm
uccuucaucccaccggagucug

SEQ ID NO: 860 - RNA, 22 nt, Artificial Sequence
  Modified miR-205 Guide strand
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (22)..(22): 2'-fluorouridine
  modified_base (24)..(24): gm
uccuucaucccaccggagucug

SEQ ID NO: 861 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (18)..(18): gm
  modified_base (22)..(22): 2'-fluorouridine
  modified_base (24)..(24): gm
uccuucaucccaccggagucug

SEQ ID NO: 862 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (17)..(17): 2'-O-methyladenosine
  modified_base (22)..(22): 2'-fluorouridine
  modified_base (24)..(24): gm
uccuucaucccaccggagucug

SEQ ID NO: 863 - RNA, 22 nt, Artificial Sequence
  Modified miR-205 Guide strand
  modified_base (9)..(9): cm
  modified_base (10)..(10): cm
  modified_base (11)..(11): cm
  modified_base (12)..(12): 2'-O-methyladenosine
  modified_base (13)..(13): cm
  modified_base (14)..(14): cm
  modified_base (15)..(15): gm
  modified_base (16)..(16): gm
  modified_base (22)..(22): 2'-fluorouridine
  modified_base (24)..(24): gm
uccuucaucccaccggagucug

SEQ ID NO: 864 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucauauccaccggagucug

SEQ ID NO: 865 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucauauccaccggagucug

SEQ ID NO: 866 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucauauccaccggagucug

SEQ ID NO: 867 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucauauccaccggagucug

SEQ ID NO: 868 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucauauccaccggagucug

SEQ ID NO: 869 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucauauccaccggagucug

SEQ ID NO: 870 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucauauccaccggagucug

SEQ ID NO: 871 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucauauccaccggagucug

SEQ ID NO: 872 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucauauccaccggagucug

SEQ ID NO: 873 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucaucuccaccggagucug

SEQ ID NO: 874 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucaucuccaccggagucug

SEQ ID NO: 875 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucaucuccaccggagucug

SEQ ID NO: 876 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucaucuccaccggagucug

SEQ ID NO: 877 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucaucuccaccggagucug

SEQ ID NO: 878 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucaucuccaccggagucug

SEQ ID NO: 879 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucaucuccaccggagucug

SEQ ID NO: 880 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucaucuccaccggagucug

SEQ ID NO: 881 - RNA, 23 nt, Artificial Sequence
  Modified miR-205 Guide strand
  modified_base (9)..(9): cm
  modified_base (10)..(10): um
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucaucuccaccggagucug

SEQ ID NO: 882 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucaucaccaccggagucug

SEQ ID NO: 883 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucaucaccaccggagucug

SEQ ID NO: 884 - RNA, 23 nt, Artificial Sequence
  Modified miR-205 Guide strand
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucaucaccaccggagucug

SEQ ID NO: 885 - RNA, 23 nt, Artificial Sequence
  Modified miR-205 Guide strand
  modified_base (10)..(10): 2'-O-methyladenosine
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucaucaccaccggagucug

SEQ ID NO: 886 - RNA, 23 nt, Artificial Sequence
  Modified miR-205 Guide strand
  modified_base (10)..(10): 2'-O-methyladenosine
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucaucaccaccggagucug

SEQ ID NO: 887 - RNA, 23 nt, Artificial Sequence
  Modified miR-205 Guide strand
  modified_base (10)..(10): 2'-O-methyladenosine
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucaucaccaccggagucug

SEQ ID NO: 888 - RNA, 23 nt, Artificial Sequence
  Modified miR-205 Guide strand
  modified_base (9)..(9): cm
  modified_base (10)..(10): 2'-O-methyladenosine
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucaucaccaccggagucug

SEQ ID NO: 889 - RNA, 23 nt, Artificial Sequence
  Modified miR-205 Guide strand
  modified_base (9)..(9): cm
  modified_base (10)..(10): 2'-O-methyladenosine
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucaucaccaccggagucug

SEQ ID NO: 890 - RNA, 23 nt, Artificial Sequence
  Modified miR-205 Guide strand
  modified_base (9)..(9): cm
  modified_base (10)..(10): 2'-O-methyladenosine
  modified_base (11)..(11): cm
  modified_base (12)..(12): cm
  modified_base (13)..(13): 2'-O-methyladenosine
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucaucaccaccggagucug

SEQ ID NO: 891 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucauauccuccggagucug

SEQ ID NO: 892 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucauauccuccggagucug

SEQ ID NO: 893 - RNA, 23 nt, Artificial Sequence
  Modified miR-205 Guide strand
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucauauccuccggagucug

SEQ ID NO: 894 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucauauccuccggagucug

SEQ ID NO: 895 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucauauccuccggagucug

SEQ ID NO: 896 - RNA, 23 nt, Artificial Sequence
  Modified miR-205 Guide strand
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucauauccuccggagucug

SEQ ID NO: 897 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (19)..(19): gm
  modified_base (23)..(23): 2'-fluorouridine
  modified_base (25)..(25): gm
uccuucauauccuccggagucug

SEQ ID NO: 898 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (18)..(18): 2'-O-methyladenosine
  modified_base (23)..(23): 2'-fluorouridine
  modified_base (25)..(25): gm
uccuucauauccuccggagucug

SEQ ID NO: 899 - RNA, 23 nt, Artificial Sequence
  Modified miR-205 Guide strand
  modified_base (9)..(9): 2'-O-methyladenosine
  modified_base (10)..(10): um
  modified_base (11)..(11): cm
  modified_base (12)..(12): cm
  modified_base (13)..(13): um
  modified_base (14)..(14): cm
  modified_base (15)..(15): cm
  modified_base (16)..(16): gm
  modified_base (17)..(17): gm
  modified_base (23)..(23): 2'-fluorouridine
  modified_base (25)..(25): gm
uccuucauauccuccggagucug

SEQ ID NO: 900 - RNA, 20 nt, Artificial Sequence
  Modified miR-30 Passenger strand
  misc_feature (1)..(1): amino C6 linker
  modified_base (1)..(1): um
  misc_feature (1)..(2): phosphorothioate linkage
  modified_base (2)..(2): cm
  misc_feature (2)..(3): phosphorothioate linkage
  modified_base (3)..(3): cm
  modified_base (7)..(7): cm
  modified_base (8)..(8): 2'-fluoroguanosine
  modified_base (9)..(9): 2'-O-methyladenosine
  modified_base (10)..(10): gm
  modified_base (18)..(18): 2'-O-methyladenosine
  misc_feature (18)..(19): phosphorothioate linkage
  modified_base (19)..(19): cm
  misc_feature (19)..(20): phosphorothioate linkage
  modified_base (20)..(20): 2'-O-methyladenosine
uccagucgaggauguuuaca

SEQ ID NO: 901 - DNA, 16 bp, Homo sapiens
uccaaacgagucuccg

SEQ ID NO: 902 - DNA, 15 bp, Homo sapiens
gauucugaaaccaga

SEQ ID NO: 903 - DNA, 16 bp, Homo sapiens
gcgggcgcccugccac

SEQ ID NO: 904 - DNA, 16 bp, Homo sapiens
ucauccagcagcaggc

SEQ ID NO: 905 - DNA, 16 bp, Homo sapiens
uagccagccagguguu

SEQ ID NO: 906 - DNA, 16 bp, Homo sapiens
cagcgucggaaggugg

SEQ ID NO: 907 - DNA, 16 bp, Homo sapiens
uagacagcgucggaag

SEQ ID NO: 908 - DNA, 16 bp, Homo sapiens
auaggauccacaggga

SEQ ID NO: 909 - DNA, 16 bp, Homo sapiens
ucuauaggauccacag

SEQ ID NO: 910 - DNA, 16 bp, Homo sapiens
gcacuaaucauccagg

SEQ ID NO: 911 - DNA, 15 bp, Homo sapiens
cagcgucggaaggug

SEQ ID NO: 912 - DNA, 20 bp, Homo sapiens
ccuagacagcgucggaaggu

SEQ ID NO: 913 - DNA, 18 bp, Homo sapiens
auaggauccacagggagg

SEQ ID NO: 914 - DNA, 18 bp, Homo sapiens
cggcucugggauccccgg

SEQ ID NO: 915 - DNA, 17 bp, Homo sapiens
ggggcggagacacgccc

SEQ ID NO: 916 - DNA, 18 bp, Homo sapiens
agaaggcaggaaucccag

SEQ ID NO: 917 - DNA, 18 bp, Homo sapiens
gcaggaaucccaggccgg

SEQ ID NO: 918 - DNA, 18 bp, Homo sapiens
ggagucucucaccgggcc

SEQ ID NO: 919 - DNA, 18 bp, Homo sapiens
gcgaggcggccucuuccg

SEQ ID NO: 920 - DNA, 18 bp, Homo sapiens
gccuccagcucccccggg

SEQ ID NO: 921 - DNA, 17 bp, Homo sapiens
ggugucgggagggccau

SEQ ID NO: 922 - DNA, 18 bp, Homo sapiens
cgguauucuuccucgcug

SEQ ID NO: 923 - DNA, 25 bp, Homo sapiens
gggcauuuuaauauaucucugaacu

SEQ ID NO: 924 - DNA, 22 bp, Homo sapiens
uaucuucugaacuaaucaucca

SEQ ID NO: 925 - DNA, 23 bp, Homo sapiens
caggagauguaacucuaauccag

SEQ ID NO: 926 - DNA, 25 bp, Homo sapiens
cucucaccgggccuagaccuagaag

SEQ ID NO: 927 - DNA, 25 bp, Homo sapiens
ugcgcacugcgcgcaggucuagcca

SEQ ID NO: 928 - DNA, 25 bp, Homo sapiens
acugcgcgcaggucuagccaggaag

SEQ ID NO: 929 - DNA, 25 bp, Homo sapiens
cggggugcgcacugcgcgcaggucu

SEQ ID NO: 930 - DNA, 30 bp, Homo sapiens
ugcgcacugcgcgcaggucuagccaggaag

SEQ ID NO: 931 - DNA, 30 bp, Homo sapiens
acugcgcgcaggucuagccaggaagcgggc

SEQ ID NO: 932 - DNA, 25 bp, Homo sapiens
acccgaccccgucccaaccccgcgu

SEQ ID NO: 933 - DNA, 19 bp, Homo sapiens
ugggcugguggagaggcag

SEQ ID NO: 934 - DNA, 25 bp, Homo sapiens
uucccugcauguuuccgggugcccg

SEQ ID NO: 935 - DNA, 19 bp, Homo sapiens
cuucccugcauguuuccgg

SEQ ID NO: 936 - DNA, 19 bp, Homo sapiens
uguggcucucguucauuuc

SEQ ID NO: 937 - DNA, 25 bp, Homo sapiens
cuccgugggagucuugagugugcca

SEQ ID NO: 938 - DNA, 19 bp, Homo sapiens
uggaacugaaccuccgugg

SEQ ID NO: 939 - DNA, 21 bp, Homo sapiens
caccccuucaugaauggcgcc

SEQ ID NO: 940 - DNA, 20 bp, Homo sapiens
acaggcuccaccccuucaug

SEQ ID NO: 941 - DNA, 20 bp, Homo sapiens
uuccgcucaaagcaggccuc

SEQ ID NO: 942 - DNA, 25 bp, Homo sapiens
aaagcgauccuucucaaaggcucgg

SEQ ID NO: 943 - DNA, 21 bp, Homo sapiens
ccugcgcgggcgcccugccgc

SEQ ID NO: 944 - DNA, 19 bp, Homo sapiens
uaucucugaacuaaucauc

SEQ ID NO: 945 - DNA, 25 bp, Homo sapiens
agcgccuggcggcggaacgcagacc

SEQ ID NO: 946 - DNA, 25 bp, Homo sapiens
aucucugcccgccuucccucccgcc

SEQ ID NO: 947 - DNA, 22 bp, Homo sapiens
aaaccagaucugaauccuggac

SEQ ID NO: 948 - DNA, 22 bp, Homo sapiens
uuucuaggagagguugcgccug

SEQ ID NO: 949 - DNA, 22 bp, Homo sapiens
ccuagacagcgucggaagguag

SEQ ID NO: 950 - RNA, 19 nt, Homo sapiens
acucaagacucccacugug

SEQ ID NO: 951 - RNA, 20 nt, Homo sapiens
cgggcgggcgcccgcggagg

SEQ ID NO: 952 - RNA, 17 nt, Homo sapiens
cagcgaugaagaaaccg

SEQ ID NO: 953 - RNA, 21 nt, Homo sapiens
gaggccugcuuuugagaggaa

SEQ ID NO: 954 - RNA, 15 nt, Homo sapiens
uggagacuguuugga

SEQ ID NO: 955 - RNA, 19 nt, Homo sapiens
acuuccggcgcugucucgg

SEQ ID NO: 956 - RNA, 16 nt, Homo sapiens
augauuguucagaaua

SEQ ID NO: 957 - RNA, 18 nt, Homo sapiens
uggaugauuguucaaaga

SEQ ID NO: 958 - RNA, 16 nt, Homo sapiens
aucugguuucagaauc

SEQ ID NO: 959 - RNA, 18 nt, Homo sapiens
aggauucagaucuguuuu

SEQ ID NO: 960 - RNA, 21 nt, Homo sapiens
gccaccugccgcgcaggcgca

SEQ ID NO: 961 - RNA, 18 nt, Homo sapiens
acucaagauucccaggag

SEQ ID NO: 962 - RNA, 18 nt, Homo sapiens
auaggauuagaucgguuu

SEQ ID NO: 963 - RNA, 18 nt, Homo sapiens
cagccaggaagaauaccu

SEQ ID NO: 964 - RNA, 18 nt, Homo sapiens
uggaagaggccgccuggc

SEQ ID NO: 965 - RNA, 17 nt, Homo sapiens
cacggaggucaguucaa

SEQ ID NO: 966 - RNA, 18 nt, Homo sapiens
aacagccugugcuggcua

SEQ ID NO: 967 - RNA, 16 nt, Homo sapiens
aacaccuggcuggcua

SEQ ID NO: 968 - RNA, 25 nt, Homo sapiens
acgcgggguugggacggggucgggu

SEQ ID NO: 969 - RNA, 22 nt, Homo sapiens
caggcgcaaccucuccuagaaa

SEQ ID NO: 970 - RNA, 19 nt, Homo sapiens
caugaagggguggagccug

SEQ ID NO: 971 - RNA, 19 nt, Homo sapiens
ccggaaacaugcagggaag

SEQ ID NO: 972 - RNA, 18 nt, Homo sapiens
ccggccugggauuccugc

SEQ ID NO: 973 - RNA, 18 nt, Homo sapiens
ccggggaucccagagccg

SEQ ID NO: 974 - RNA, 23 nt, Homo sapiens
cuccuggcugcaccugccgcagu

SEQ ID NO: 975 - RNA, 19 nt, Homo sapiens
cugccucuccaccagccca

SEQ ID NO: 976 - RNA, 18 nt, Homo sapiens
cugggauuccugccuucu

SEQ ID NO: 977 - RNA, 19 nt, Homo sapiens
gaaaugaacgagagccaca

SEQ ID NO: 978 - RNA, 19 nt, Homo sapiens
gcaccugccgcagugcaca

SEQ ID NO: 979 - RNA, 18 nt, Homo sapiens
gccauucaugaaggggug

SEQ ID NO: 980 - RNA, 18 nt, Homo sapiens
gccccgggggagcuggag

SEQ ID NO: 981 - RNA, 16 nt, Homo sapiens
gccugcugcuggauga

SEQ ID NO: 982 - RNA, 24 nt, Homo sapiens
ggcacacucaagacucccacggag

SEQ ID NO: 983 - RNA, 23 nt, Homo sapiens
ggcacccggaaacaugcagggaa

SEQ ID NO: 984 - RNA, 17 nt, Homo sapiens
ggccggugagagacucc

SEQ ID NO: 985 - RNA, 25 nt, Homo sapiens
ggcgggagggaaggcgggcagagau

SEQ ID NO: 986 - RNA, 17 nt, Homo sapiens
gggcgugucuccgcccc

SEQ ID NO: 987 - RNA, 20 nt, Homo sapiens
uccaggccggugagagacuc

SEQ ID NO: 988 - RNA, 21 nt, Homo sapiens
ucccacggagguucaguucca

SEQ ID NO: 989 - RNA, 18 nt, Homo sapiens
ucggaagaggcgccucgc

SEQ ID NO: 990 - RNA, 21 nt, Homo sapiens
ugcguuccgccgccaggcgcu

SEQ ID NO: 991 - RNA, 18 nt, Homo sapiens
cagcgaggaagaauaccg

SEQ ID NO: 992 - RNA, 18 nt, Homo sapiens
gccccgggggagccggag

SEQ ID NO: 993 - RNA, 20 nt, Homo sapiens
gucuuugagaggaucccuuu

SEQ ID NO: 994 - RNA, 15 nt, Homo sapiens
aucugguuucagaac

SEQ ID NO: 995 - RNA, 20 nt, Homo sapiens
gggcccuucuugaaggggug

SEQ ID NO: 996 - RNA, 16 nt, Homo sapiens
gauggcccuccugaca

SEQ ID NO: 997 - RNA, 16 nt, Homo sapiens
aacaccuggcuggcua

SEQ ID NO: 998 - RNA, 23 nt, Homo sapiens
accugcgcgcagugcgcaccccg

SEQ ID NO: 999 - RNA, 20 nt, Homo sapiens
accuuccgacgcugucuagg

SEQ ID NO: 1000 - RNA, 25 nt, Homo sapiens
acgcgggguugggacggggucgggu

SEQ ID NO: 1001 - RNA, 23 nt, Homo sapiens
agcagaccugcgcgcagugcgca

SEQ ID NO: 1002 - RNA, 18 nt, Homo sapiens
agcucgcuggccucucug

SEQ ID NO: 1003 - RNA, 25 nt, Homo sapiens
aguucagagauauauuaaaaugccc

SEQ ID NO: 1004 - RNA, 16 nt, Homo sapiens
aucugguuucagaauc

SEQ ID NO: 1005 - RNA, 18 nt, Homo sapiens
augauuaguucagagaua

SEQ ID NO: 1006 - RNA, 18 nt, Homo sapiens
auggcccucccgacaccc

SEQ ID NO: 1007 - RNA, 16 nt, Homo sapiens
cagaccugcgcgcagu

SEQ ID NO: 1008 - RNA, 22 nt, Homo sapiens
caggcgcaaccucuccuagaaa

SEQ ID NO: 1009 - RNA, 16 nt, Homo sapiens
ccaccuuccgacgcug

SEQ ID NO: 1010 - RNA, 18 nt, Homo sapiens
ccggccugggauuccugc

SEQ ID NO: 1011 - RNA, 18 nt, Homo sapiens
ccggggaucccagagccg

SEQ ID NO: 1012 - RNA, 18 nt, Homo sapiens
ccucccuguggauccuau

SEQ ID NO: 1013 - RNA, 19 nt, Homo sapiens
ccugccucuccaccagccc

SEQ ID NO: 1014 - RNA, 32 nt, Homo sapiens
ccugcgcgcagugcgcaccccggcugacgugc

SEQ ID NO: 1015 - RNA, 16 nt, Homo sapiens
ccuggaugauuaguuc

SEQ ID NO: 1016 - RNA, 18 nt, Homo sapiens
cgacacccucggacagca

SEQ ID NO: 1017 - RNA, 16 nt, Homo sapiens
cggagacucguuugga

SEQ ID NO: 1018 - RNA, 23 nt, Homo sapiens
cuggauuagaguuacaucuccug

SEQ ID NO: 1019 - RNA, 18 nt, Homo sapiens
cugggauuccugccuucu

SEQ ID NO: 1020 - RNA, 15 nt, Homo sapiens
cuguggauccuauag

SEQ ID NO: 1021 - RNA, 16 nt, Homo sapiens
cuuccgacgcugucua

SEQ ID NO: 1022 - RNA, 19 nt, Homo sapiens
gagccugcuuugagcggaa

SEQ ID NO: 1023 - RNA, 23 nt, Homo sapiens
gagccuuugagaaggaucgcuuu

SEQ ID NO: 1024 - RNA, 18 nt, Homo sapiens
gccccgggggagcuggag

SEQ ID NO: 1025 - RNA, 16 nt, Homo sapiens
gccugcugcuggauga

SEQ ID NO: 1026 - RNA, 18 nt, Homo sapiens
ggcccggugagagacucc

SEQ ID NO: 1027 - RNA, 18 nt, Homo sapiens
gggagcucgcuggccucu

SEQ ID NO: 1028 - RNA, 17 nt, Homo sapiens
gggcgugucuccgcccc

SEQ ID NO: 1029 - RNA, 22 nt, Homo sapiens
guccaggauucagaucugguuu

SEQ ID NO: 1030 - RNA, 21 nt, Homo sapiens
guggcagggcgcccgcgcagg

SEQ ID NO: 1031 - RNA, 22 nt, Homo sapiens
uaccagcagaccugcgcgcagu

SEQ ID NO: 1032 - RNA, 16 nt, Homo sapiens
ucccuguggauccuau

SEQ ID NO: 1033 - RNA, 18 nt, Homo sapiens
ucggaagaggccgccucg

SEQ ID NO: 1034 - RNA, 20 nt, Homo sapiens
ucuaggcccggugagagacu

SEQ ID NO: 1035 - RNA, 18 nt, Homo sapiens
uggaugauuaguucagag

SEQ ID NO: 1036 - RNA, 18 nt, Homo sapiens
cagcgaggaagaauaccg

SEQ ID NO: 1037 - RNA, 16 nt, Homo sapiens
aucugguuucagaauc

SEQ ID NO: 1038 - RNA, 16 nt, Homo sapiens
gauggcccuccugaca

SEQ ID NO: 1039 - RNA, 18 nt, Homo sapiens
auggccccccgcacccuc

SEQ ID NO: 1040 - RNA, 16 nt, Homo sapiens
cugugguuucagaauc

SEQ ID NO: 1041 - RNA, 20 nt, Homo sapiens
acuuugaaaaggaucucuuu

SEQ ID NO: 1042 - RNA, 19 nt, Homo sapiens
uggagauuagaucagagug

SEQ ID NO: 1043 - RNA, 18 nt, Homo sapiens
ccugcgcgcacugcgccu

SEQ ID NO: 1044 - RNA, 18 nt, Homo sapiens
cagagggguggagccugu

SEQ ID NO: 1045 - RNA, 20 nt, Homo sapiens
cauaaagggguggaaccugu

SEQ ID NO: 1046 - RNA, 14 nt, Homo sapiens
cggagacuuuugga

SEQ ID NO: 1047 - RNA, 18 nt, Homo sapiens
guggcaggagcagcccgc

SEQ ID NO: 1048 - RNA, 23 nt, Homo sapiens
ccaccccgcgcgugcgcgccccg

SEQ ID NO: 1049 - RNA, 26 nt, Homo sapiens
ugaggcggcggcgcagugcgcccccg

SEQ ID NO: 1050 - RNA, 25 nt, Homo sapiens
cgccgccccgcgcaggcgcccccgc

SEQ ID NO: 1051 - RNA, 14 nt, Homo sapiens
cuucgacgcuguca

SEQ ID NO: 1052 - RNA, 18 nt, Homo sapiens
gccauucaugauggugug

SEQ ID NO: 1053 - RNA, 16 nt, Homo sapiens
auguuaguucagagaa

SEQ ID NO: 1054 - RNA, 21 nt, Homo sapiens
cuggccucuccaccagcccuu

SEQ ID NO: 1055 - RNA, 17 nt, Homo sapiens
aggaucagaucugguuu

SEQ ID NO: 1056 - RNA, 17 nt, Homo sapiens
accaccauggcuggcua

SEQ ID NO: 1057 - RNA, 16 nt, Homo sapiens
aucugguuucagaauc

SEQ ID NO: 1058 - RNA, 20 nt, Homo sapiens
gccuaccgccgccaggcgcu

SEQ ID NO: 1059 - RNA, 17 nt, Homo sapiens
gguuugaguuacaucua

SEQ ID NO: 1060 - RNA, 18 nt, Homo sapiens
uggagucagaucugguuu

SEQ ID NO: 1061 - RNA, 19 nt, Homo sapiens
ccuggaaacaugcaggcaa

SEQ ID NO: 1062 - RNA, 19 nt, Homo sapiens
cgacagccuggacagcaac

SEQ ID NO: 1063 - RNA, 19 nt, Homo sapiens
cuggaaacaugcaggcaag

SEQ ID NO: 1064 - RNA, 18 nt, Homo sapiens
ucggagggccgccucgac

SEQ ID NO: 1065 - RNA, 19 nt, Homo sapiens
ucucccuguggauccucau

SEQ ID NO: 1066 - RNA, 18 nt, Homo sapiens
cacugagguccaguucca

SEQ ID NO: 1067 - RNA, 16 nt, Homo sapiens
cuguggaauccuauaa

SEQ ID NO: 1068 - RNA, 16 nt, Homo sapiens
gccugcugcuggauga

SEQ ID NO: 1069 - RNA, 18 nt, Homo sapiens
gccuuugcugcuggauga

SEQ ID NO: 1070 - RNA, 18 nt, Homo sapiens
acucaagaauccccggag

SEQ ID NO: 1071 - RNA, 18 nt, Homo sapiens
accuuccuacgugcuagg

SEQ ID NO: 1072 - RNA, 23 nt, Homo sapiens
caguugccuagaccuggagcagu

SEQ ID NO: 1073 - RNA, 17 nt, Homo sapiens
acucaagccccacggag

SEQ ID NO: 1074 - RNA, 23 nt, Homo sapiens
cacagagauauuuuaaaauucuu

SEQ ID NO: 1075 - RNA, 17 nt, Homo sapiens
cuguggauccugacaga

SEQ ID NO: 1076 - RNA, 18 nt, Homo sapiens
ggcccggugagagacucc

SEQ ID NO: 1077 - RNA, 20 nt, Homo sapiens
ucuaggcccggugagagacu

SEQ ID NO: 1078 - RNA, 17 nt, Homo sapiens
uuugagaaggauguuuu

SEQ ID NO: 1079 - RNA, 17 nt, Homo sapiens
cucaccucuccuagaaa

SEQ ID NO: 1080 - RNA, 18 nt, Homo sapiens
aagaugcagaucugguuu

SEQ ID NO: 1081 - RNA, 18 nt, Homo sapiens
gguagggacggggcgggu

SEQ ID NO: 1082 - RNA, 18 nt, Homo sapiens
cagcgaggaagaaugccu

SEQ ID NO: 1083 - RNA, 17 nt, Homo sapiens
gccauucaugagggguc

SEQ ID NO: 1084 - RNA, 15 nt, Homo sapiens
cugaccugccgcagu

SEQ ID NO: 1085 - RNA, 25 nt, Homo sapiens
aacagagauauauguaaaauugcca

SEQ ID NO: 1086 - RNA, 22 nt, Homo sapiens
guccaggacucacagcugguuu

SEQ ID NO: 1087 - RNA, 19 nt, Homo sapiens
ggagggaagcgggcagagu

SEQ ID NO: 1088 - RNA, 17 nt, Homo sapiens
cagaaggggggagccug

SEQ ID NO: 1089 - RNA, 19 nt, Homo sapiens
cagcagaccugcgcgcagu

SEQ ID NO: 1090 - RNA, 19 nt, Homo sapiens
ggagauagaguuacaucuu

SEQ ID NO: 1091 - RNA, 20 nt, Homo sapiens
ccugcgcccagugcggaccu

SEQ ID NO: 1092 - RNA, 19 nt, Homo sapiens
uaccuucgacacugucagg

SEQ ID NO: 1093 - RNA, 20 nt, Homo sapiens
uggcuuccgccgccaggccu

SEQ ID NO: 1094 - RNA, 16 nt, Homo sapiens
cuuccagaccugucua

SEQ ID NO: 1095 - RNA, 16 nt, Homo sapiens
ugggacggggucgcgu

SEQ ID NO: 1096 - RNA, 19 nt, Homo sapiens
gaaauguaccagagccaca

SEQ ID NO: 1097 - RNA, 28 nt, Homo sapiens
ggcugagccgcgcagugcggacccucgc

SEQ ID NO: 1098 - RNA, 17 nt, Homo sapiens
gggggcgcccgcgcagg

SEQ ID NO: 1099 - RNA, 18 nt, Homo sapiens
augauuauuuuagagaua

SEQ ID NO: 1100 - RNA, 28 nt, Homo sapiens
ggcugggaggggaaggcgggucagagau

SEQ ID NO: 1101 - RNA, 17 nt, Homo sapiens
ggauugagauacaucug

SEQ ID NO: 1102 - RNA, 21 nt, Homo sapiens
agaucgcgcagugcgccccag

SEQ ID NO: 1103 - RNA, 16 nt, Homo sapiens
ccugcgcgcgugccac

SEQ ID NO: 1104 - RNA, 14 nt, Homo sapiens
guggcaggcgccgc

SEQ ID NO: 1105 - RNA, 18 nt, Homo sapiens
gguuuagaguuacauucu

SEQ ID NO: 1106 - RNA, 15 nt, Homo sapiens
cuguggauccuauaa

SEQ ID NO: 1107 - RNA, 16 nt, Homo sapiens
ggccuguggauccuau

SEQ ID NO: 1108 - RNA, 18 nt, Homo sapiens
auggccuuccugacaccc

SEQ ID NO: 1109 - RNA, 19 nt, Homo sapiens
ucugggccgggugagagac

SEQ ID NO: 1110 - RNA, 20 nt, Homo sapiens
cuggcugcccugcgugcagu

SEQ ID NO: 1111 - RNA, 16 nt, Homo sapiens
ggcugguuucagaauc

SEQ ID NO: 1112 - RNA, 15 nt, Homo sapiens
cugagacucguugga

SEQ ID NO: 1113 - RNA, 16 nt, Homo sapiens
gccugcugcuggauga

SEQ ID NO: 1114 - RNA, 19 nt, Homo sapiens
caggaaggguggagccugc

SEQ ID NO: 1115 - RNA, 20 nt, Homo sapiens
gcggcaaggcgccgcgcagg

SEQ ID NO: 1116 - RNA, 18 nt, Homo sapiens
gaggccuguuugagggaa

SEQ ID NO: 1117 - RNA, 19 nt, Homo sapiens
cauccagggguggagccug

SEQ ID NO: 1118 - RNA, 20 nt, Homo sapiens
accuucagacgugucugagg

SEQ ID NO: 1119 - RNA, 19 nt, Homo sapiens
agauuagaguuaaucuccc

SEQ ID NO: 1120 - RNA, 19 nt, Homo sapiens
uugccucuccagcagcccu

What is claimed is:

1. An engineered microRNA (miRNA) or salt thereof, wherein the engineered miRNA or salt thereof comprises SEQ ID NO: 88.

2. An engineered passenger oligonucleotide or salt thereof, wherein the engineered passenger oligonucleotide or salt thereof comprises SEQ ID NO: 96, and wherein the engineered passenger oligonucleotide or salt thereof is no more than 20 nucleotides in length.

3. A nucleic acid construct comprising a first strand comprising SEQ ID NO: 88 and a second strand comprising SEQ ID NO: 96.

4. A pharmaceutical composition comprising the nucleic acid construct of claim 3 and a pharmaceutically acceptable excipient, diluent, or carrier.

5. The pharmaceutical composition of claim 4, in unit dose form.

6. The pharmaceutical composition of claim 4, wherein the pharmaceutical composition is encapsulated.

7. The pharmaceutical composition of claim 4, wherein the pharmaceutical composition is in the form of a liquid.

8. A method of treating a cancer in a subject in need thereof comprising: administering to the subject a therapeutically effective amount of the pharmaceutical composition of claim 4.

9. The method of claim 8, wherein the administering is by an intravenous injection, an intramuscular injection, an intrathecal injection, an intraorbital injection, a subcutaneous injection, or any combination thereof.

10. The method of claim 8, wherein the administering is oral, otic, ocular, rectal, or any combination thereof.

11. The method of claim 8, wherein the method further comprises a second administering comprising administering a second therapy to the subject.

12. The method of claim 11, wherein the administering and the second administering are concurrent.

13. The method of claim 11, wherein the administering and the second administering are sequential.

14. The method of claim 8, wherein the cancer is a head cancer, a neck cancer, skin cancer, a cervical cancer, a prostate cancer, a lung cancer or any combination thereof.

15. The method of claim 8, wherein the subject has been diagnosed with the cancer by a diagnostic test.

16. The method of claim 15, wherein the diagnostic test comprises an imaging procedure, a blood count analysis, a tissue pathology analysis, a biomarker analysis, or any combination thereof.

* * * * *

UNITED STATES PATENT AND TRADEMARK OFFICE
CERTIFICATE OF CORRECTION

PATENT NO. : 11,597,930 B2
APPLICATION NO. : 17/692644
DATED : March 7, 2023
INVENTOR(S) : Robert Place, Anthony Saleh and Tishan Williams Page 1 of 1

It is certified that error appears in the above-identified patent and that said Letters Patent is hereby corrected as shown below:

In the Specification

In Column 1, please replace the Statement of Government Support paragraph with the following new paragraph:
This invention was made with government support under U43 CA221567, and HHSN272201800034C awarded by the National Institutes of Health. The government has certain rights in the invention.

Signed and Sealed this
Twentieth Day of June, 2023

Katherine Kelly Vidal
*Director of the United States Patent and Trademark Office*